United States Patent
Rai

(10) Patent No.: US 12,077,759 B2
(45) Date of Patent: Sep. 3, 2024

(54) COMPOSITIONS AND METHODS FOR TREATING PATHOLOGIC CALCIFICATION

(71) Applicant: Muhammad Farooq Rai, St. Louis, MO (US)

(72) Inventor: Muhammad Farooq Rai, St. Louis, MO (US)

(73) Assignee: Washington University, St. Louis, MO (US)

( * ) Notice: Subject to any disclaimer, the term of this patent is extended or adjusted under 35 U.S.C. 154(b) by 0 days.

(21) Appl. No.: 17/814,968

(22) Filed: Jul. 26, 2022

(65) Prior Publication Data

US 2023/0058864 A1    Feb. 23, 2023

Related U.S. Application Data

(60) Provisional application No. 63/227,095, filed on Jul. 29, 2021.

(51) Int. Cl.
*C12N 15/11* (2006.01)
*A61P 19/00* (2006.01)
*C12N 15/113* (2010.01)

(52) U.S. Cl.
CPC .......... *C12N 15/1135* (2013.01); *A61P 19/00* (2018.01); *C12N 2310/122* (2013.01)

(58) Field of Classification Search
CPC .................. C12N 2310/122; C12N 15/113
See application file for complete search history.

(56) References Cited

U.S. PATENT DOCUMENTS

2009/0137473 A1* 5/2009 Martin .................. C07K 14/47
514/4.8

* cited by examiner

*Primary Examiner* — Ekaterina Poliakova-Georgantas

(57) ABSTRACT

Among the various aspects of the present disclosure is the provision of methods for treating pathologic calcification or bone formation and methods of inhibiting KIF26B that include administering a therapeutically effective amount of a synthetic nucleic acid against KIF26B. Compositions comprising a small hairpin RNA (shRNA) against KIF26B are also provided.

2 Claims, 24 Drawing Sheets
(24 of 24 Drawing Sheet(s) Filed in Color)
Specification includes a Sequence Listing.

shRNA sequence (*Homo sapiens* KIF26B)

shRNA sequence (*Mus musculus* Kif26b)

COMPOSITIONS AND METHODS FOR TREATING PATHOLOGIC CALCIFICATION

CROSS-REFERENCE TO RELATED APPLICATIONS

This application claims priority from U.S. Provisional Application Ser. No. 63/227,095 filed on 29 Jul. 2021, which is incorporated herein by reference in its entirety.

STATEMENT REGARDING FEDERALLY SPONSORED RESEARCH OR DEVELOPMENT

Not applicable.

MATERIAL INCORPORATED-BY-REFERENCE

The Sequence Listing, which is a part of the present disclosure, includes a computer-readable form comprising nucleotide and/or amino acid sequences of the present invention (file name "019814-US-NP_Sequence_Listing_replacement.xml" created on 21 Sep. 2023, 1,011,269 bytes). The subject matter of the Sequence Listing is incorporated herein by reference in its entirety.

FIELD OF THE INVENTION

The present disclosure generally relates to methods for treating or preventing pathologic calcification or bone formation using synthetic nucleotides targeted to KIF26B.

SUMMARY OF THE INVENTION

Among the various aspects of the present disclosure are methods for treating pathologic calcification or bone formation and methods of inhibiting KIF26B.

One aspect of the present disclosure provides for a method of treating or preventing pathologic calcification or bone formation in a subject comprising administering a therapeutically effective amount of a synthetic nucleic acid against KIF26B.

In some embodiments, the synthetic nucleic acid comprises SEQ ID NO: 1 or a sequence at least about 80% identical to SEQ ID NO: 1; SEQ ID NO: 2 or a sequence at least about 80% identical to SEQ ID NO: 2; or any variant thereof having KIF26B inhibiting activity.

In some embodiments, the synthetic nucleic acid is a small hairpin RNA (shRNA).

In some embodiments, the therapeutically effective amount of the synthetic nucleic acid reduces KIF26B mRNA or protein expression.

In some embodiments, the subject has or is suspected of having intra-articular ectopic calcification.

In some embodiments, the intra-articular ectopic calcification is injury-induced ectopic calcification or surgery-induced ectopic calcification.

In some embodiments, the subject has or is suspected of having pathologic osteogenesis, heterotopic ossification, pathologic bone formation, osteoarthritis, arthroplasty, or a traumatic injury.

In some embodiments, the therapeutically effective amount of the synthetic nucleic acid reduces or prevents osteogenesis; increases chondrogenesis; reduces expression of osteogenic marker genes; increases expression of chondrogenic marker genes; or reduces expression of Wnt/β-catenin pathway genes.

In some embodiments, the therapeutically effective amount of the synthetic nucleic acid reduces cell proliferation, reduces cell viability, or induces cell apoptosis.

In some embodiments, the cell is a progenitor cell, a stem cell, a cell capable of osteogenic differentiation, or a cell capable of chondrogenic differentiation.

In some embodiments, the therapeutically effective amount of the synthetic nucleic acid reduces or prevents ectopic calcification or formation of calcified nodules.

In some embodiments, the therapeutically effective amount of the synthetic nucleic acid is administered intra-articularly.

Another aspect of the present disclosure provides for a method of inhibiting KIF26B expression in a subject in need thereof, the method comprising administrating a therapeutically effective amount of a synthetic nucleic acid against KIF26B.

In some embodiments, the synthetic nucleic acid is a small hairpin RNA (shRNA).

In some embodiments, the synthetic nucleic acid comprises SEQ ID NO: 1 or a sequence at least about 80% identical to SEQ ID NO: 1; SEQ ID NO: 2 or a sequence at least about 80% identical to SEQ ID NO: 2; or any variant thereof having KIF26B inhibiting activity.

In some embodiments, the subject has or is suspected of having intra-articular ectopic calcification.

In some embodiments, the therapeutically effective amount of the synthetic nucleic acid is administered intra-articularly.

Another aspect of the present disclosure provides for a composition comprising a small hairpin RNA (shRNA) against KIF26B, the shRNA comprising SEQ ID NO: 1 or a sequence at least about 80% identical to SEQ ID NO: 1; SEQ ID NO: 2 or a sequence at least about 80% identical to SEQ ID NO: 2; or any variant thereof having KIF26B inhibiting activity.

In some embodiments, the shRNA reduces KIF26B mRNA or protein expression.

In some embodiments, the composition further comprises a lentivirus.

Other objects and features will be in part apparent and in part pointed out hereinafter.

DESCRIPTION OF THE DRAWINGS

The patent or application file contains at least one drawing executed in color. Copies of this patent or patent application publication with color drawing(s) will be provided by the Office upon request and payment of the necessary fee.

Those of skill in the art will understand that the drawings, described below, are for illustrative purposes only. The drawings are not intended to limit the scope of the present teachings in any way.

and total β-catenin € were significantly lower in the KIF26B shRNA group compared to the scrambled shRNA group (Unpaired t-test).

FIG. 9A-FIG. 9F. Wnt agonist rescued the loss of osteogenesis due to KIF26B knockdown. A-B. The expression of WNT16 |A| and AXIN2 |B| mRNA was increased significantly in ACLp cells treated with SKL2001 compared with vehicle (DMSO) (n=3 each, Mann-Whitney test). C. Addition of Wnt agonist SKL2001 reversed osteogenesis suppression by KIF26B loss-of-function in cells transduced with KIF26B shRNA as shown by macro and micrographs of cells stained with Alizarin red (n=3 each, scale bar=100 βm). D. After 7 days of osteogenic induction, the protein levels of active and total β-catenin lost due to KIF26B were also regained with SKL2001 treatment (n=3 each). E-F. Quantification of signal intensity of active β-catenin (E) and total β-catenin (F) confirmed the expression pattern of active and total β-catenin (1-way ANOVA with Tukey's post hoc test).

Figure 10:
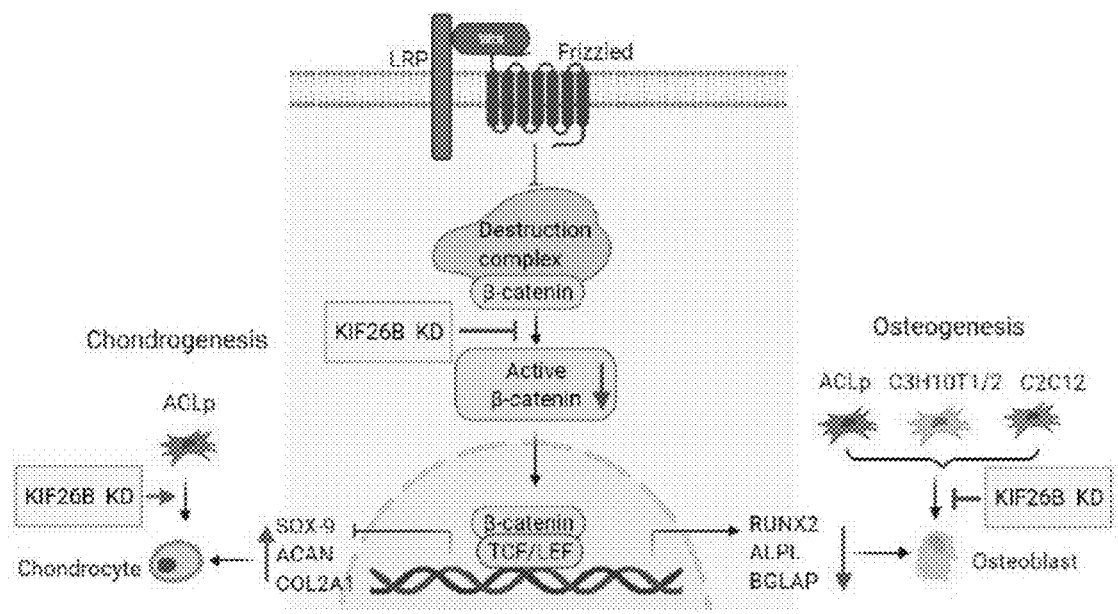

FIG. 10. Schematic of a proposed mechanism of KIF26B in ectopic calcification and its interaction with Wnt/β-catenin signaling. KIF26B inhibition decreases β-catenin levels by increasing the degradation of β-catenin. It resulted in suppression of osteogenesis and the expression of typical osteogenic-specific marker genes; and elevation of chondrogenesis as well as elevation of chondrogenic-specific marker genes.

Figure 11A:
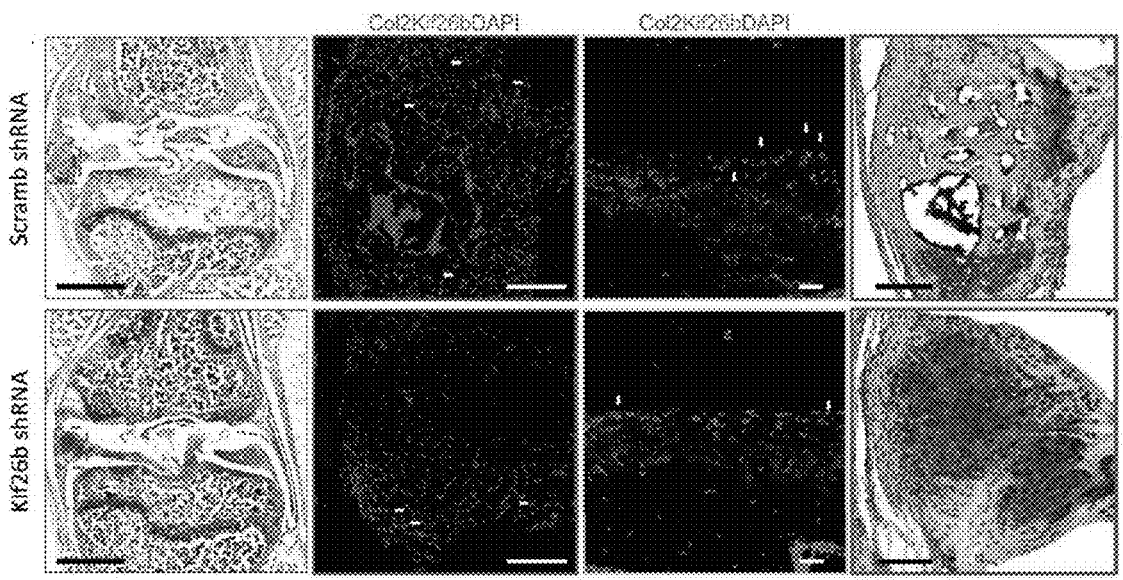
Figure 11B:
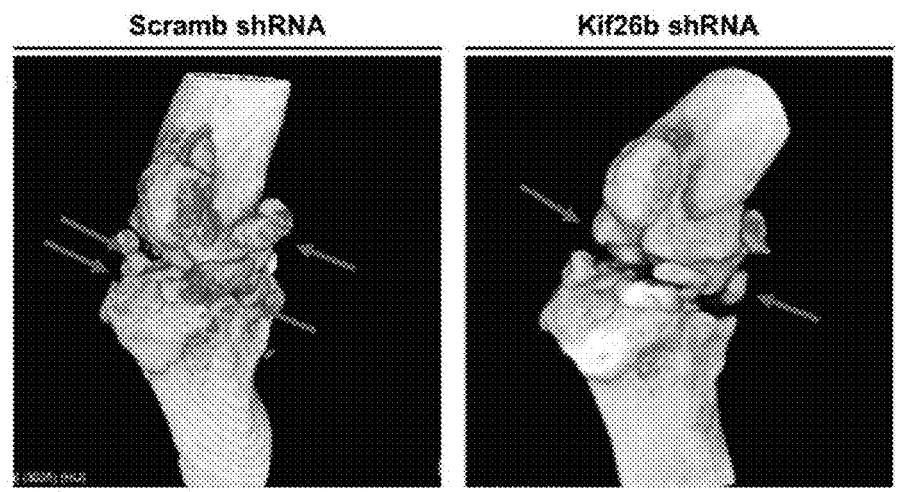
Figure 11C:
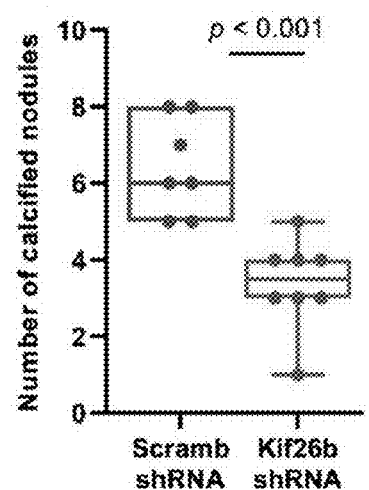

FIG. 11A-FIG. 11C. Kif26b shRNA prompted chondrogenesis and inhibited ectopic calcification in mice. A. Representative low magnification histology images (scale bar=1 mm) are shown for scrambled and Kif26b shRNA groups to provide an overview of the knee joint and ectopic nodule. Confocal microscopy images of Kif26b immunostaining (white arrowhead) in the calcified nodule (red square) or cartilage area (orange square) showing decreased staining intensity of Kif26b in the Kif26b shRNA group indicative of successful Kif26b knockdown in vivo (green=Kif26b, red=Col 2, blue=DAPI, Scale bars=100 μm). In addition, Safranin O staining of nodules showed increased staining intensity in the Kif26b shRNA group compared with the scrambled shRNA group (Scale bar=100 μm) (n=3 each). B. Representative μCT images at 8 weeks are shown demonstrating less calcified nodules in mice receiving Kif26b shRNA (n=8) compared with those receiving scrambled shRNA (n=7) (red arrows point to nodules) C. Quantification of calcified nodules showed that the number of calcified nodules was significantly lower in mice treated with Kif26b shRNA than those treated with shRNA at 8 weeks (Unpaired t-test).

FIG. 12A-FIG. 12D. ACLp cells express stromal cell markers and exhibit the potential for osteogenesis. A. Cells egressing from ACL explants over a period of 3 weeks (scale bar=200 μm) B. Immunofluorescence staining using antibodies against selected stromal cell markers showed that ACLp cells expressed CD44, CD90, CD146, and Stro-1, and did not express CD14 and CD19 indicating that ACLp cells are progenitor/stromal cells (n=3 each). Blue=DAPI; Green=Surface marker; Red=actin, scale bar=50 μm C. When subjected to osteogenic induction medium, ACLp cells successfully differentiated into osteoblasts depicting their multipotent differentiation potential (scale bar=100 μm). D. Increased osteogenic differentiation of ACLp cells was also evidenced by a significant increase in the expression of ALPL mRNA, a marker of osteogenesis (n=6) (Mann-Whitney test).

Figure 13:
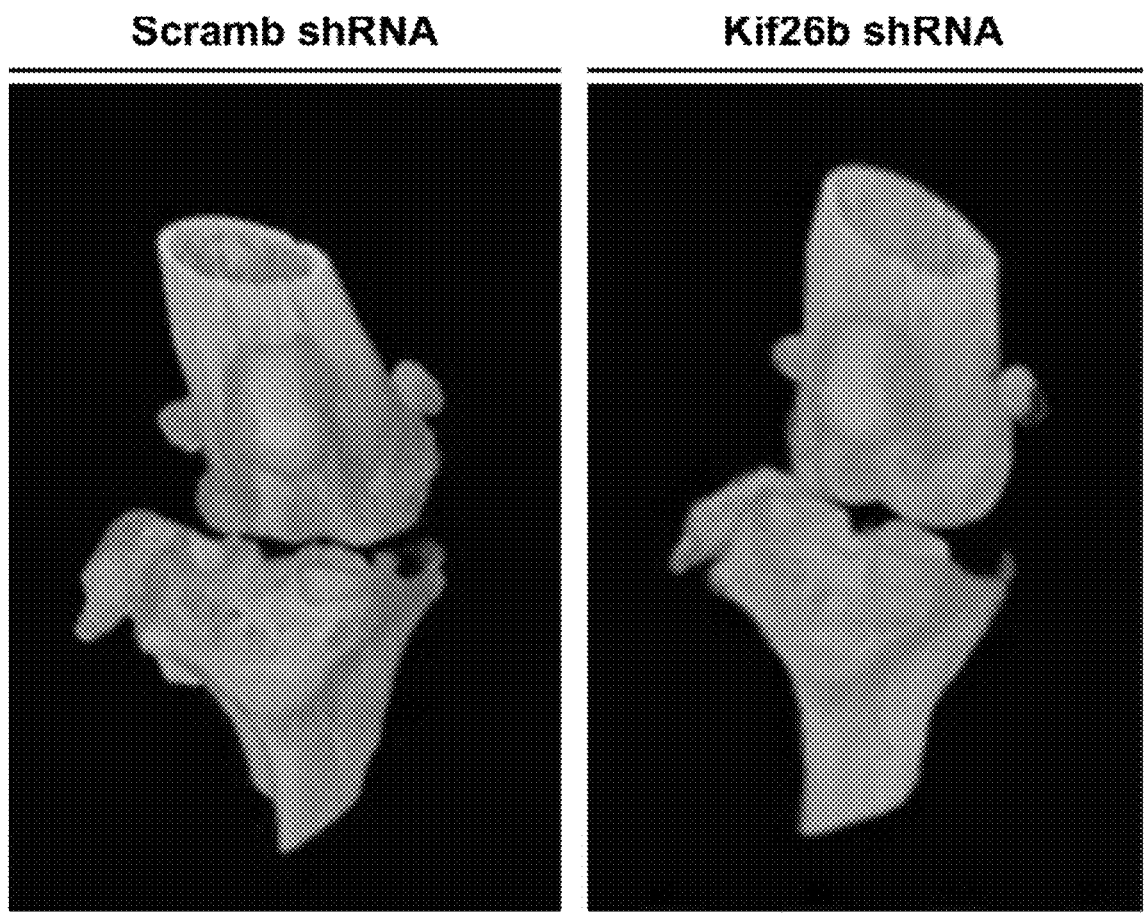
Figure 14A:
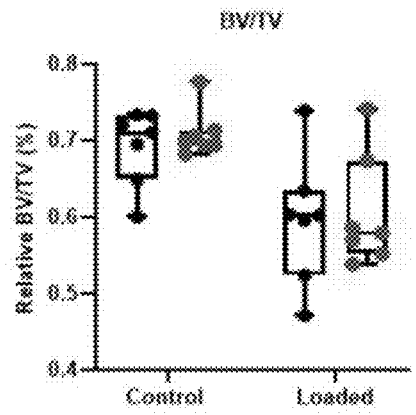
Figure 14B:
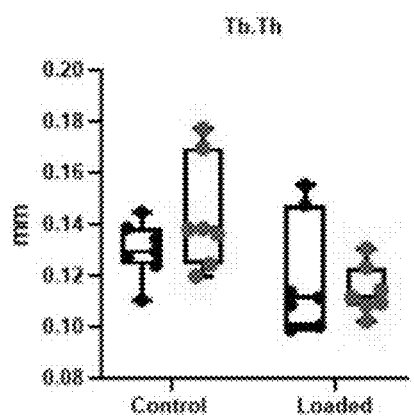
Figure 14C:
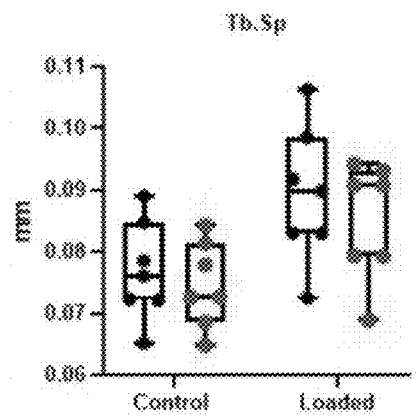
Figure 14D:
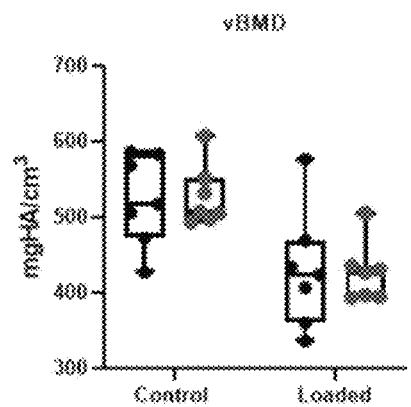
Figure 14E:
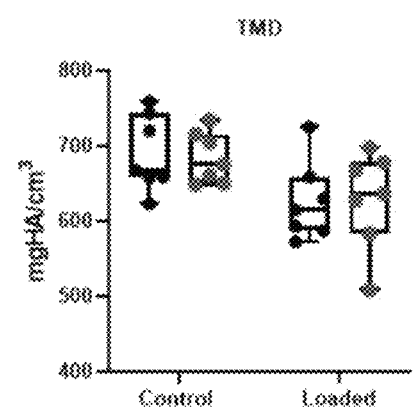
Figure 14F:
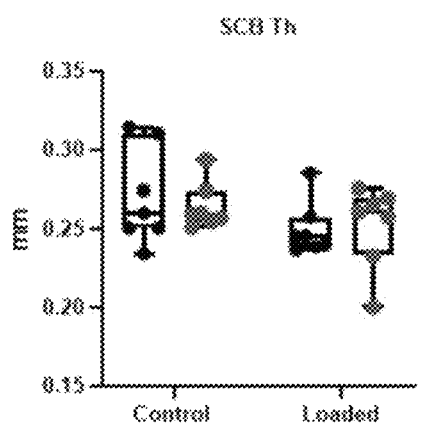

FIG. 13. Effect of KIF26B shRNA on ectopic calcification at 4-week time point. Intra-articular delivery of Kif26b shRNA did not reduce the number of calcified nodules at 4 weeks after injury as determined by in vivo μCT analysis (n=2 each).

FIG. 14A-FIG. 14F. Effect of KIF26B shRNA on trabecular and subchondral bone parameters. A-E. Trabecular bone parameters for loaded (n=7) and control (n=7) knees showed neither significant load*treatment interaction effect nor treatment effect: bone volume/total volume (BV/TV) (A), trabecular thickness (Tb.Th) (B), trabecular spacing (Tb.Sp) (C), volumetric bone mineral density (vBMD) (D), and tissue mineral density (TMD) € (2-way ANOVA with Šidák's multiple comparison test). F. No significant loading*treatment interaction was found for subchondral bone (SCB) thickness. (2-way ANOVA with Šidák's multiple comparison test). Black filled circle=scrambled shRNA; red filled circle=Kif26b shRNA.

DETAILED DESCRIPTION OF THE INVENTION

The present disclosure is based, at least in part, on the discovery that kinesis superfamily member 26b (KIF26B) is associated with injury-induced ectopic calcification. As described herein, inhibition of KIF26B using a synthetic nucleic acid significantly arrested osteogenesis of progenitor/stem cells and hampered the development of intra-articular ectopic calcification after injury (see Example 1). Thus, KIF26B is a therapeutic target for treating or preventing pathologic calcification, bone formation, or related disorders.

Ectopic calcification is an osteogenic process that leads to the formation of inappropriate bone within intra-articular soft tissues, often in response to injury or surgery. The molecular mechanisms governing this phenotype have yet to be determined. Currently, there are no treatments for ectopic calcification other than corrective surgical procedures.

As described herein, an association between kinesin superfamily member 26b (KIF26B) and injury-induced ectopic calcification was discovered through quantitative trait locus (QTL) analysis. KIF26B is a member of the kinesin superfamily of microtubule motor proteins known to be expressed in bone. KIF26B was previously identified as a potential severity locus in a GWAS study of patients with hip osteoarthritis. However, its function and mechanistic role in ectopic calcification were not fully understood.

As described herein, KIF26B was found to play a functional role in osseous and chondrogenic transdifferentiation of human and murine progenitor/stem cells and in a murine model of non-invasive injury-induced intra-articular ectopic calcification. KIF26B ablation via lentivirus-mediated shRNA significantly arrested osteogenesis of progenitor/ stem cells and suppressed the expression of typical osteogenic marker genes. Conversely, KIF26B loss-of-function increased chondrogenesis and expression of chondrogenic marker genes. Further, KIF26B knockdown significantly decreased cell viability and proliferation and induced cellular apoptosis.

As described herein, intra-articular delivery of KIF26B shRNA in mice significantly hampered the development of intra-articular ectopic calcification after injury, with no effect on already formed bone.

KIF26B plays a crucial role in ectopic bone formation by repressing osteogenesis, but not chondrogenesis, via modulating Wnt/β-catenin signaling. As described herein, KIF26B is a critical determinant of the osteogenic process in pathologic endochondral bone formation and an actionable target for pharmacotherapy to mitigate ectopic calcification and heterotopic ossification.

Kif26B-Targeted Synthetic Nucleic Acid

One aspect of the present disclosure provides for a synthetic nucleic acid against KIF26B. As described herein, shRNA sequences were designed to specifically target and silence Kif26b mRNA in *Homo sapiens* and *Mus musculus* (see e.g., Example 1).

As described herein, a synthetic nucleic acid against KIF26B can reduce or prevent the onset and progression of ectopic calcification in the intra-articular region. A synthetic nucleic acid against KIF26B can be any synthetic nucleic acid that can inhibit KIF26B, downregulate KIF26B, silence KIF26B, or knockdown KIF26B.

As an example, the synthetic nucleic acid against KIF26B can be a small hairpin RNA (shRNA). As another example, the synthetic nucleic acid against KIF26B can be a short interfering RNA (siRNA).

As another example, RNA (e.g., long noncoding RNA (lncRNA)) can be targeted with antisense oligonucleotides (ASOs) as a therapeutic. Processes for making ASOs targeted to RNAs are well known; see e.g. Zhou et al. 2016 Methods Mol Biol. 1402:199-213. Except as otherwise noted herein, therefore, the process of the present disclosure can be carried out in accordance with such processes.

In some embodiments, the synthetic nucleic acid against KIF26B comprises CTTGGCTCTTCAAGCTCAT-AACTCGAGTTATGAGCTTGAAGAGCCAAGTTTT T-3' (SEQ ID NO: 1), 5'-ctgacaacctgctcatcttatctcgagataagat-gagcaggttgtcagttttt-3' (SEQ ID NO: 2), or a variant thereof having KIF26B silencing activity. As described herein, a synthetic nucleic acid comprising SEQ ID NO: 1 or SEQ ID NO: 2 suppressed the expression of KIF26B both at mRNA and protein levels (see e.g., Example 1).

While exemplary synthetic nucleic acids against KIF26B have been provided, it can be appreciated by one of skill in the art that variants of such nucleic acids may be used, provided they exhibit KIF26B inhibiting activity. KIF26B inhibiting activity of a synthetic nucleic acid can be verified by any means known in the art. For example, RT-qPCR can be used to measure the expression of KIF26B mRNA in cells transfected with a synthetic nucleic acid against KIF26B compared to a control. As another example, a Western blot can be used to measure the expression of KIF26B protein in cells transfected with a synthetic nucleic acid against KIF26B compared to a control. A synthetic nucleic acid having KIF26B inhibiting activity would be expected to reduce KIF26B mRNA or protein expression compared to a control.

In some embodiments, the synthetic nucleic acid can be a KIF26B-derived nucleic acid. A KIF26B-derived nucleic acid can be any nucleic acid derived from the KIF26B sequence having KIF26B inhibiting activity, e.g., reduces KIF26B expression at the mRNA or protein level.

For example, the KIF26B-derived nucleic acid can be derived from the *Homo sapiens* KIF26B genetic sequence (SEQ ID NO: 3) or corresponding RNA or complementary sequence thereof. As another example, the KIF26B-derived nucleic acid can be derived from the *Mus musculus* KIF26B genetic sequence (SEQ ID NO: 4) or corresponding RNA or complementary sequence thereof.

Inhibition of agents as described herein can be determined by standard pharmaceutical procedures in assays or cell cultures for determining the $IC_{50}$. The half maximal inhibitory concentration ($IC_{50}$) is a measure of the potency of a substance in inhibiting a specific biological or biochemical function. The $IC_{50}$ is a quantitative measure that indicates how much of a particular inhibitory substance (e.g., pharmaceutical agent or drug) is needed to inhibit, in vitro, a given biological process or biological component by 50%. The biological component could be an enzyme, cell, cell receptor, or microorganism, for example. $IC_{50}$ values are typically expressed as molar concentration. $IC_{50}$ is generally used as a measure of antagonist drug potency in pharmacological research. $IC_{50}$ is comparable to other measures of potency, such as $EC_{50}$ for excitatory drugs. $EC_{50}$ represents the dose or plasma concentration required for obtaining 50% of a maximum effect in vivo. $IC_{50}$ can be determined with functional assays or with competition binding assays.

Molecular Engineering

The following definitions and methods are provided to better define the present invention and to guide those of ordinary skill in the art in the practice of the present invention. Unless otherwise noted, terms are to be understood according to conventional usage by those of ordinary skill in the relevant art.

The term "transfection," as used herein, refers to the process of introducing nucleic acids into cells by non-viral methods. The term "transduction," as used herein, refers to the process whereby foreign DNA is introduced into another cell via a viral vector.

The terms "heterologous DNA sequence", "exogenous DNA segment", or "heterologous nucleic acid," as used herein, each refers to a sequence that originates from a source foreign to the particular host cell or, if from the same source, is modified from its original form. Thus, a heterologous gene in a host cell includes a gene that is endogenous to the particular host cell but has been modified through, for example, the use of DNA shuffling or cloning. The terms also include non-naturally occurring multiple copies of a naturally occurring DNA sequence. Thus, the terms refer to a DNA segment that is foreign or heterologous to the cell, or homologous to the cell but in a position within the host cell nucleic acid in which the element is not ordinarily found. Exogenous DNA segments are expressed to yield exogenous polypeptides. A "homologous" DNA sequence is a DNA sequence that is naturally associated with a host cell into which it is introduced.

Expression vector, expression construct, plasmid, or recombinant DNA construct is generally understood to refer to a nucleic acid that has been generated via human intervention, including by recombinant means or direct chemical synthesis, with a series of specified nucleic acid elements that permit transcription or translation of a particular nucleic acid in, for example, a host cell. The expression vector can be part of a plasmid, virus, or nucleic acid fragment. Typically, the expression vector can include a nucleic acid to be transcribed operably linked to a promoter.

An "expression vector", otherwise known as an "expression construct", is generally a plasmid or virus designed for gene expression in cells. The vector is used to introduce a specific gene into a target cell, and can commandeer the cell's mechanism for protein synthesis to produce the protein encoded by the gene. Expression vectors are the basic tools in biotechnology for the production of proteins. The vector is engineered to contain regulatory sequences that act as enhancer and/or promoter regions and lead to efficient transcription of the gene carried on the expression vector. The goal of a well-designed expression vector is the efficient production of protein, and this may be achieved by the production of a significant amount of stable messenger RNA, which can then be translated into protein. The expression of a protein may be tightly controlled, and the protein is only produced in significant quantity when necessary through the use of an inducer, in some systems however the protein may be expressed constitutively. As described herein, *Escherichia coli* is used as the host for protein production, but other cell types may also be used.

In molecular biology, an "inducer" is a molecule that regulates gene expression. An inducer can function in two ways, such as:

(i) By disabling repressors. The gene is expressed because an inducer binds to the repressor. The binding of the inducer to the repressor prevents the repressor from binding to the operator. RNA polymerase can then begin to transcribe operon genes.

(ii) By binding to activators. Activators generally bind poorly to activator DNA sequences unless an inducer is present. An activator binds to an inducer and the complex binds to the activation sequence and activates target gene. Removing the inducer stops transcription. Because a small inducer molecule is required, the increased expression of the target gene is called induction.

Repressor proteins bind to the DNA strand and prevent RNA polymerase from being able to attach to the DNA and synthesize mRNA. Inducers bind to repressors, causing them to change shape and preventing them from binding to DNA. Therefore, they allow transcription, and thus gene expression, to take place.

For a gene to be expressed, its DNA sequence must be copied (in a process known as transcription) to make a smaller, mobile molecule called messenger RNA (mRNA), which carries the instructions for making a protein to the site where the protein is manufactured (in a process known as translation). Many different types of proteins can affect the level of gene expression by promoting or preventing transcription. In prokaryotes (such as bacteria), these proteins often act on a portion of DNA known as the operator at the beginning of the gene. The promoter is where RNA polymerase, the enzyme that copies the genetic sequence and synthesizes the mRNA, attaches to the DNA strand.

Some genes are modulated by activators, which have the opposite effect on gene expression as repressors. Inducers can also bind to activator proteins, allowing them to bind to the operator DNA where they promote RNA transcription. Ligands that bind to deactivate activator proteins are not, in the technical sense, classified as inducers, since they have the effect of preventing transcription.

A "promoter" is generally understood as a nucleic acid control sequence that directs transcription of a nucleic acid. An inducible promoter is generally understood as a promoter that mediates transcription of an operably linked gene in response to a particular stimulus. A promoter can include necessary nucleic acid sequences near the start site of transcription, such as, in the case of a polymerase II type promoter, a TATA element. A promoter can optionally include distal enhancer or repressor elements, which can be located as many as several thousand base pairs from the start site of transcription.

A "ribosome binding site", or "ribosomal binding site (RBS)", refers to a sequence of nucleotides upstream of the start codon of an mRNA transcript that is responsible for the recruitment of a ribosome during the initiation of translation. Generally, RBS refers to bacterial sequences, although internal ribosome entry sites (IRES) have been described in mRNAs of eukaryotic cells or viruses that infect eukaryotes. Ribosome recruitment in eukaryotes is generally mediated by the 5' cap present on eukaryotic mRNAs.

A "transcribable nucleic acid molecule" as used herein refers to any nucleic acid molecule capable of being transcribed into an RNA molecule. Methods are known for introducing constructs into a cell in such a manner that the transcribable nucleic acid molecule is transcribed into a functional mRNA molecule that is translated and therefore expressed as a protein product. Constructs may also be constructed to be capable of expressing antisense RNA molecules, in order to inhibit translation of a specific RNA molecule of interest. For the practice of the present disclosure, conventional compositions and methods for preparing and using constructs and host cells are well known to one skilled in the art (see e.g., Sambrook and Russel (2006) Condensed Protocols from Molecular Cloning: A Laboratory Manual, Cold Spring Harbor Laboratory Press, ISBN-10: 0879697717; Ausubel et al. (2002) Short Protocols in Molecular Biology, 5th ed., Current Protocols, ISBN-10: 0471250929; Sambrook and Russel (2001) Molecular Cloning: A Laboratory Manual, 3d ed., Cold Spring Harbor Laboratory Press, ISBN-10: 0879695773; Elhai, J. and Wolk, C. P. 1988. Methods in Enzymology 167, 747-754).

The "transcription start site" or "initiation site" is the position surrounding the first nucleotide that is part of the transcribed sequence, which is also defined as position +1. With respect to this site, all other sequences of the gene and its controlling regions can be numbered. Downstream sequences (i.e., further protein encoding sequences in the 3' direction) can be denominated positive, while upstream sequences (mostly of the controlling regions in the 5' direction) are denominated negative.

"Operably-linked" or "functionally linked" refers preferably to the association of nucleic acid sequences on a single nucleic acid fragment so that the function of one is affected by the other. For example, a regulatory DNA sequence is said to be "operably linked to" or "associated with" a DNA sequence that codes for an RNA or a polypeptide if the two sequences are situated such that the regulatory DNA sequence affects expression of the coding DNA sequence (i.e., that the coding sequence or functional RNA is under the transcriptional control of the promoter). Coding sequences can be operably-linked to regulatory sequences in sense or antisense orientation. The two nucleic acid molecules may be part of a single contiguous nucleic acid molecule and may be adjacent. For example, a promoter is operably linked to a gene of interest if the promoter regulates or mediates transcription of the gene of interest in a cell.

A "construct" is generally understood as any recombinant nucleic acid molecule such as a plasmid, cosmid, virus, autonomously replicating nucleic acid molecule, phage, or linear or circular single-stranded or double-stranded DNA or RNA nucleic acid molecule, derived from any source, capable of genomic integration or autonomous replication, comprising a nucleic acid molecule where one or more nucleic acid molecule has been operably linked.

A construct of the present disclosure can contain a promoter operably linked to a transcribable nucleic acid molecule operably linked to a 3' transcription termination nucleic acid molecule. In addition, constructs can include but are not limited to additional regulatory nucleic acid molecules from, e.g., the 3-untranslated region (3' UTR). Constructs can include but are not limited to the 5' untranslated regions (5' UTR) of an mRNA nucleic acid molecule which can play an important role in translation initiation and can also be a genetic component in an expression construct. These additional upstream and downstream regulatory nucleic acid molecules may be derived from a source that is native or heterologous with respect to the other elements present on the promoter construct.

The term "transformation" refers to the transfer of a nucleic acid fragment into the genome of a host cell, resulting in genetically stable inheritance. Host cells containing the transformed nucleic acid fragments are referred to as "transgenic" cells, and organisms comprising transgenic cells are referred to as "transgenic organisms".

"Transformed," "transgenic," and "recombinant" refer to a host cell or organism such as a bacterium, cyanobacterium, animal, or a plant into which a heterologous nucleic acid molecule has been introduced. The nucleic acid molecule can be stably integrated into the genome as generally known in the art and disclosed (Sambrook 1989; Innis 1995; Gelfand 1995; Innis & Gelfand 1999). Known methods of PCR include, but are not limited to, methods using paired primers, nested primers, single specific primers, degenerate primers, gene-specific primers, vector-specific primers, partially mismatched primers, and the like. The term "untransformed" refers to normal cells that have not been through the transformation process.

"Wild-type" refers to a virus or organism found in nature without any known mutation.

Design, generation, and testing of the variant nucleotides, and their encoded polypeptides, having the above-required percent identities and retaining a required activity of the expressed protein are within the skill of the art. For example, directed evolution and rapid isolation of mutants can be according to methods described in references including, but not limited to, Link et al. (2007) Nature Reviews 5(9), 680-688; Sanger et al. (1991) Gene 97(1), 119-123; Ghadessy et al. (2001) Proc Natl Acad Sci USA 98(8) 4552-4557. Thus, one skilled in the art could generate a large number of nucleotide and/or polypeptide variants having, for example, at least 95-99% identity to the reference sequence described herein and screen such for desired phenotypes according to methods routine in the art.

Nucleotide and/or amino acid sequence identity percent (%) is understood as the percentage of nucleotide or amino acid residues that are identical with nucleotide or amino acid residues in a candidate sequence in comparison to a reference sequence when the two sequences are aligned. To determine percent identity, sequences are aligned and if necessary, gaps are introduced to achieve the maximum percent sequence identity. Sequence alignment procedures to determine percent identity are well known to those of skill in the art. Often publicly available computer software such as BLAST, BLAST2, ALIGN2, or Megalign (DNASTAR) software is used to align sequences. Those skilled in the art can determine appropriate parameters for measuring alignment, including any algorithms needed to achieve maximal alignment over the full-length of the sequences being compared. When sequences are aligned, the percent sequence identity of a given sequence A to, with, or against a given sequence B (which can alternatively be phrased as a given sequence A that has or comprises a certain percent sequence identity to, with, or against a given sequence B) can be calculated as: percent sequence identity=X/Y100, where X is the number of residues scored as identical matches by the sequence alignment program's or algorithm's alignment of A and B and Y is the total number of residues in B. If the length of sequence A is not equal to the length of sequence B, the percent sequence identity of A to B will not equal the percent sequence identity of B to A. For example, the percent identity can be at least 80% or about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, or about 100%.

Substitution refers to the replacement of one amino acid with another amino acid in a protein or the replacement of one nucleotide with another in DNA or RNA. Insertion refers to the insertion of one or more amino acids in a protein or the insertion of one or more nucleotides with another in DNA or RNA. Deletion refers to the deletion of one or more amino acids in a protein or the deletion of one or more nucleotides with another in DNA or RNA. Generally, substitutions, insertions, or deletions can be made at any position so long as the required activity is retained.

So-called conservative exchanges can be carried out in which the amino acid which is replaced has a similar property as the original amino acid, for example, the exchange of Glu by Asp, Gln by Asn, Val by Ile, Leu by Ile, and Ser by Thr. For example, amino acids with similar properties can be Aliphatic amino acids (e.g., Glycine, Alanine, Valine, Leucine, Isoleucine); hydroxyl or sulfur/selenium-containing amino acids (e.g., Serine, Cysteine, Selenocysteine, Threonine, Methionine); Cyclic amino acids (e.g., Proline); Aromatic amino acids (e.g., Phenylalanine, Tyrosine, Tryptophan); Basic amino acids (e.g., Histidine, Lysine, Arginine); or Acidic and their Amide (e.g., Aspartate, Glutamate, Asparagine, Glutamine). Deletion is the replacement of an amino acid by a direct bond. Positions for deletions include the termini of a polypeptide and linkages between individual protein domains. Insertions are introductions of amino acids into the polypeptide chain, a direct bond formally being replaced by one or more amino acids. An amino acid sequence can be modulated with the help of art-known computer simulation programs that can produce a polypeptide with, for example, improved activity or altered regulation. On the basis of these artificially generated polypeptide sequences, a corresponding nucleic acid molecule coding for such a modulated polypeptide can be synthesized in-vitro using the specific codon-usage of the desired host cell.

"Highly stringent hybridization conditions" are defined as hybridization at 65° C. in a 6×SSC buffer (i.e., 0.9 M sodium chloride and 0.09 M sodium citrate). Given these conditions, a determination can be made as to whether a given set of sequences will hybridize by calculating the melting temperature ($T_m$) of a DNA duplex between the two sequences. If a particular duplex has a melting temperature lower than 65° C. in the salt conditions of a 6×SSC, then the two sequences will not hybridize. On the other hand, if the melting temperature is above 65° C. in the same salt conditions, then the sequences will hybridize. In general, the melting temperature for any hybridized DNA:DNA sequence can be determined using the following formula: $T_m=81.5°$ C.$+16.6(\log_{10}[Na^+])+0.41$ (fraction G/C content)$-0.63$(% formamide)$-(600/l)$. Furthermore, the $T_m$ of a DNA:DNA hybrid is decreased by 1-1.5° C. for every 1% decrease in nucleotide identity (see e.g., Sambrook and Russel, 2006).

Host cells can be transformed using a variety of standard techniques known to the art (see e.g., Sambrook and Russel (2006) Condensed Protocols from Molecular Cloning: A Laboratory Manual, Cold Spring Harbor Laboratory Press, ISBN-10: 0879697717; Ausubel et al. (2002) Short Protocols in Molecular Biology, 5th ed., Current Protocols, ISBN-10: 0471250929; Sambrook and Russel (2001) Molecular Cloning: A Laboratory Manual, 3d ed., Cold Spring Harbor Laboratory Press, ISBN-10: 0879695773; Elhai, J. and Wolk, C. P. 1988. Methods in Enzymology 167, 747-754). Such techniques include, but are not limited to, viral infection, calcium phosphate transfection, liposome-mediated transfection, microprojectile-mediated delivery, receptor-mediated uptake, cell fusion, electroporation, and the like. The transformed cells can be selected and propagated to provide recombinant host cells that comprise the expression vector stably integrated in the host cell genome.

Conservative Substitutions I

| Side Chain Characteristic | Amino Acid |
|---|---|
| Aliphatic Non-polar | G A P I L V |
| Polar-uncharged | C S T M N Q |
| Polar-charged | D E K R |
| Aromatic | H F W Y |
| Other | N Q D E |

Conservative Substitutions II

| Side Chain Characteristic | Amino Acid |
|---|---|
| Non-polar (hydrophobic) | |
| A. Aliphatic: | A L I V P |
| B. Aromatic: | F W |
| C. Sulfur-containing: | M |
| D. Borderline: | G |
| Uncharged-polar | |
| A. Hydroxyl: | S T Y |
| B. Amides: | N Q |
| C. Sulfhydryl: | C |
| D. Borderline: | G |
| Positively Charged (Basic): | K R H |
| Negatively Charged (Acidic): | D E |

Conservative Substitutions III

| Original Residue | Exemplary Substitution |
|---|---|
| Ala (A) | Val, Leu, Ile |
| Arg (R) | Lys, Gln, Asn |
| Asn (N) | Gln, His, Lys, Arg |
| Asp (D) | Glu |
| Cys (C) | Ser |
| Gln (Q) | Asn |
| Glu (E) | Asp |
| His (H) | Asn, Gln, Lys, Arg |
| Ile (I) | Leu, Val, Met, Ala, Phe, |
| Leu (L) | Ile, Val, Met, Ala, Phe |
| Lys (K) | Arg, Gln, Asn |
| Met (M) | Leu, Phe, Ile |
| Phe (F) | Leu, Val, Ile, Ala |
| Pro (P) | Gly |
| Ser (S) | Thr |
| Thr (T) | Ser |
| Trp (W) | Tyr, Phe |
| Tyr (Y) | Trp, Phe, Tur, Ser |
| Val (V) | Ile, Leu, Met, Phe, Ala |

Exemplary nucleic acids that may be introduced to a host cell include, for example, DNA sequences or genes from another species, or even genes or sequences which originate with or are present in the same species, but are incorporated into recipient cells by genetic engineering methods. The term "exogenous" is also intended to refer to genes that are not normally present in the cell being transformed, or perhaps simply not present in the form, structure, etc., as found in the transforming DNA segment or gene, or genes which are normally present and that one desires to express in a manner that differs from the natural expression pattern, e.g., to over-express. Thus, the term "exogenous" gene or DNA is intended to refer to any gene or DNA segment that is introduced into a recipient cell, regardless of whether a similar gene may already be present in such a cell. The type of DNA included in the exogenous DNA can include DNA that is already present in the cell, DNA from another individual of the same type of organism, DNA from a different organism, or a DNA generated externally, such as a DNA sequence containing an antisense message of a gene, or a DNA sequence encoding a synthetic or modified version of a gene.

Host strains developed according to the approaches described herein can be evaluated by a number of means known in the art (see e.g., Studier (2005) Protein Expr Purif. 41(1), 207-234; Gellissen, ed. (2005) Production of Recombinant Proteins: Novel Microbial and Eukaryotic Expression Systems, Wiley-VCH, ISBN-10: 3527310363; Baneyx (2004) Protein Expression Technologies, Taylor & Francis, ISBN-10: 0954523253).

Methods of down-regulation or silencing genes are known in the art. For example, expressed protein activity can be down-regulated or eliminated using antisense oligonucleotides (ASOs), protein aptamers, nucleotide aptamers, and RNA interference (RNAi) (e.g., small interfering RNAs (siRNA), short hairpin RNA (shRNA), and micro RNAs (miRNA) (see e.g., Rinaldi and Wood (2017) Nature Reviews Neurology 14, describing ASO therapies; Fanning and Symonds (2006) Handb Exp Pharmacol. 173, 289-303G, describing hammerhead ribozymes and small hairpin RNA; Helene, et al. (1992) Ann. N.Y. Acad. Sci. 660, 27-36; Maher (1992) Bioassays 14(12): 807-15, describing targeting deoxyribonucleotide sequences; Lee et al. (2006) Curr Opin Chem Biol. 10, 1-8, describing aptamers; Reynolds et al. (2004) Nature Biotechnology 22(3), 326-330, describing RNAi; Pushparaj and Melendez (2006) Clinical and Experimental Pharmacology and Physiology 33(5-6), 504-510, describing RNAi; Dillon et al. (2005) Annual Review of Physiology 67, 147-173, describing RNAi; Dykxhoorn and Lieberman (2005) Annual Review of Medicine 56, 401-423, describing RNAi). RNAi molecules are commercially available from a variety of sources (e.g., Ambion, TX; Sigma Aldrich, MO; Invitrogen). Several siRNA molecule design programs using a variety of algorithms are known to the art (see e.g., Cenix algorithm, Ambion; BLOCK-iT™ RNAi Designer, Invitrogen; siRNA Whitehead Institute Design Tools, Bioinformatics & Research Computing). Traits influential in defining optimal siRNA sequences include G/C content at the termini of the siRNAs, $T_m$ of specific internal domains of the siRNA, siRNA length, position of the target sequence within the CDS (coding region), and nucleotide content of the 3' overhangs.

Genome Editing

As described herein, KIF26B signals can be modulated (e.g., reduced, eliminated, or enhanced) using genome editing. Processes for genome editing are well known; see e.g. Aldi 2018 Nature Communications 9(1911). Except as otherwise noted herein, therefore, the process of the present disclosure can be carried out in accordance with such processes.

For example, genome editing can comprise CRISPR/Cas9, CRISPR-Cpf1, TALEN, or ZNFs. Adequate blockage of KIF26B by genome editing can result in protection from ectopic intra-articular ossification.

As an example, clustered regularly interspaced short palindromic repeats (CRISPR)/CRISPR-associated (Cas) systems are a new class of genome-editing tools that target desired genomic sites in mammalian cells. Recently published type II CRISPR/Cas systems use Cas9 nuclease that is targeted to a genomic site by complexing with a synthetic guide RNA that hybridizes to a 20-nucleotide DNA sequence and immediately preceding an NGG motif recognized by Cas9 (thus, a $(N)_{20}$NGG target DNA sequence). This results in a double-strand break three nucleotides upstream of the NGG motif. The double strand break instigates either non-homologous end-joining, which is error-prone and conducive to frameshift mutations that knock out gene alleles, or homology-directed repair, which can be exploited with the use of an exogenously introduced double-strand or single-strand DNA repair template to knock in or correct a mutation in the genome.

For example, the methods as described herein can comprise a method for altering a target polynucleotide sequence in a cell comprising contacting the polynucleotide sequence with a clustered regularly interspaced short palindromic repeats-associated (Cas) protein.

As shown herein, entivirus was used as the vector for shRNA. Any vector known in the art can be used. For example, the vector can be a viral vector selected from retrovirus, lentivirus, herpes, adenovirus, adeno-associated virus (AAV), rabies, Ebola, lentivirus, or hybrids thereof.

| Strategy | |
|---|---|
| Viral Vectors | |
| Retroviruses | Retroviruses are RNA viruses transcribing their single-stranded genome into a double-stranded DNA copy, which can integrate into host chromosome |
| Adenoviruses (Ad) | Ad can transfect a variety of quiescent and proliferating cell types from various species and can mediate robust gene expression |
| Adeno-associated Viruses (AAV) | Recombinant AAV vectors contain no viral DNA and can carry ~4.7 kb of foreign transgenic material. They are replication defective and can replicate only while coinfecting with a helper virus |
| Non-viral vectors | |
| plasmid DNA (pDNA) | pDNA has many desired characteristics as a gene therapy vector; there are no limits on the size or genetic constitution of DNA, it is relatively inexpensive to supply, and unlike viruses, antibodies are not generated against DNA in normal individuals |
| RNAi | RNAi is a powerful tool for gene specific silencing that could be useful as an enzyme reduction therapy or means to promote read-through of a premature stop codon |

Formulation

The agents and compositions described herein can be formulated by any conventional manner using one or more pharmaceutically acceptable carriers or excipients as described in, for example, Remington's Pharmaceutical Sciences (A. R. Gennaro, Ed.), 21st edition, ISBN: 0781746736 (2005), incorporated herein by reference in its entirety. Such formulations will contain a therapeutically effective amount of a biologically active agent described herein, which can be in purified form, together with a suitable amount of carrier so as to provide the form for proper administration to the subject.

The term "formulation" refers to preparing a drug in a form suitable for administration to a subject, such as a human. Thus, a "formulation" can include pharmaceutically acceptable excipients, including diluents or carriers.

The term "pharmaceutically acceptable" as used herein can describe substances or components that do not cause unacceptable losses of pharmacological activity or unacceptable adverse side effects. Examples of pharmaceutically acceptable ingredients can be those having monographs in United States Pharmacopeia (USP 29) and National Formulary (NF 24), United States Pharmacopeial Convention, Inc, Rockville, Maryland, 2005 ("USP/NF"), or a more recent edition, and the components listed in the continuously updated Inactive Ingredient Search online database of the FDA. Other useful components that are not described in the USP/NF, etc. may also be used.

The term "pharmaceutically acceptable excipient," as used herein, can include any and all solvents, dispersion media, coatings, antibacterial and antifungal agents, isotonic, or absorption delaying agents. The use of such media and agents for pharmaceutically active substances is well known in the art (see generally Remington's Pharmaceutical Sciences (A. R. Gennaro, Ed.), 21st edition, ISBN: 0781746736 (2005)). Except insofar as any conventional media or agent is incompatible with an active ingredient, its use in the therapeutic compositions is contemplated. Supplementary active ingredients can also be incorporated into the compositions.

A "stable" formulation or composition can refer to a composition having sufficient stability to allow storage at a convenient temperature, such as between about 0° C. and about 60° C., for a commercially reasonable period of time, such as at least about one day, at least about one week, at least about one month, at least about three months, at least about six months, at least about one year, or at least about two years.

The formulation should suit the mode of administration. The agents of use with the current disclosure can be formulated by known methods for administration to a subject using several routes which include, but are not limited to, parenteral, pulmonary, oral, topical, intradermal, intratumoral, intranasal, inhalation (e.g., in an aerosol), implanted, intramuscular, intraperitoneal, intravenous, intrathecal, intracranial, intracerebroventricular, subcutaneous, intranasal, epidural, intrathecal, ophthalmic, transdermal, buccal, and rectal. The individual agents may also be administered in combination with one or more additional agents or together with other biologically active or biologically inert agents. Such biologically active or inert agents may be in fluid or mechanical communication with the agent(s) or attached to the agent(s) by ionic, covalent, Van der Waals, hydrophobic, hydrophilic, or other physical forces.

Controlled-release (or sustained-release) preparations may be formulated to extend the activity of the agent(s) and reduce dosage frequency. Controlled-release preparations can also be used to affect the time of onset of action or other characteristics, such as blood levels of the agent, and consequently, affect the occurrence of side effects. Controlled-release preparations may be designed to initially release an amount of an agent(s) that produces the desired therapeutic effect, and gradually and continually release other amounts of the agent to maintain the level of therapeutic effect over an extended period of time. In order to maintain a near-constant level of an agent in the body, the agent can be released from the dosage form at a rate that will replace the amount of agent being metabolized or excreted from the body. The controlled-release of an agent may be stimulated by various inducers, e.g., change in pH, change in temperature, enzymes, water, or other physiological conditions or molecules.

Agents or compositions described herein can also be used in combination with other therapeutic modalities, as described further below. Thus, in addition to the therapies described herein, one may also provide to the subject other therapies known to be efficacious for treatment of the disease, disorder, or condition.

Therapeutic Methods

Also provided is a process of treating or preventing pathologic calcification or bone formation in a subject in need of administration of a therapeutically effective amount of a synthetic nucleic acid against KIF26B, so as to reduce KIF26B mRNA or protein expression, reduce or prevent osteogenesis, increase chondrogenesis, reduce expression of osteogenic marker genes, increase expression of chondrogenic marker genes, reduces expression of Wnt/β-catenin pathway genes, reduce cell proliferation or viability, induce cell apoptosis, or reduce or prevent ectopic calcification or formation of calcified nodules.

Methods described herein are generally performed on a subject in need thereof. A subject in need of the therapeutic methods described herein can be a subject having, diagnosed with, suspected of having, or at risk for developing pathologic calcification or bone formation. A determination of the need for treatment will typically be assessed by a history, physical exam, or diagnostic tests consistent with the disease or condition at issue. Diagnosis of the various conditions treatable by the methods described herein is within the skill of the art. The subject can be an animal subject, including a mammal, such as horses, cows, dogs, cats, sheep, pigs, mice, rats, monkeys, hamsters, guinea pigs, and humans or chickens. For example, the subject can be a human subject.

Generally, a safe and effective amount of a synthetic nucleic acid against KIF26B is, for example, an amount that would cause the desired therapeutic effect in a subject while minimizing undesired side effects. In various embodiments, an effective amount of a synthetic nucleic acid against KIF26B described herein can substantially inhibit pathologic calcification or bone formation, slow the progress of pathologic calcification or bone formation, or limit the development of pathologic calcification or bone formation.

According to the methods described herein, administration can be parenteral, pulmonary, oral, topical, intradermal, intramuscular, intraperitoneal, intravenous, intratumoral, intrathecal, intracranial, intracerebroventricular, subcutaneous, intranasal, epidural, ophthalmic, buccal, or rectal administration.

When used in the treatments described herein, a therapeutically effective amount of a synthetic nucleic acid against KIF26B can be employed in pure form or, where such forms exist, in pharmaceutically acceptable salt form and with or without a pharmaceutically acceptable excipient. For example, the compounds of the present disclosure can be administered, at a reasonable benefit/risk ratio applicable to any medical treatment, in a sufficient amount to reduce KIF26B mRNA or protein expression, reduce or prevent osteogenesis, increase chondrogenesis, reduce expression of osteogenic marker genes, increase expression of chondrogenic marker genes, reduces expression of Wnt/β-catenin pathway genes, reduce cell proliferation or viability, induce cell apoptosis, or reduce or prevent ectopic calcification or formation of calcified nodules.

The amount of a composition described herein that can be combined with a pharmaceutically acceptable carrier to produce a single dosage form will vary depending upon the subject or host treated and the particular mode of administration. It will be appreciated by those skilled in the art that the unit content of agent contained in an individual dose of each dosage form need not in itself constitute a therapeutically effective amount, as the necessary therapeutically effective amount could be reached by administration of a number of individual doses.

Toxicity and therapeutic efficacy of compositions described herein can be determined by standard pharmaceutical procedures in cell cultures or experimental animals for determining the $LD_{50}$ (the dose lethal to 50% of the population) and the $ED_{50}$, (the dose therapeutically effective in 50% of the population). The dose ratio between toxic and therapeutic effects is the therapeutic index that can be expressed as the ratio $LD_{50}/ED_{50}$, where larger therapeutic indices are generally understood in the art to be optimal.

The specific therapeutically effective dose level for any particular subject will depend upon a variety of factors including the disorder being treated and the severity of the disorder; the activity of the specific compound employed; the specific composition employed; the age, body weight, general health, sex and diet of the subject; the time of administration; the route of administration; the rate of excretion of the composition employed; the duration of the treatment; drugs used in combination or coincidental with the specific compound employed; and like factors well known in the medical arts (see e.g., Koda-Kimble et al. (2004) Applied Therapeutics: The Clinical Use of Drugs, Lippincott Williams & Wilkins, ISBN 0781748453; Winter (2003) Basic Clinical Pharmacokinetics, 4$^{th}$ ed., Lippincott Williams & Wilkins, ISBN 0781741475; Sharqel (2004) Applied Biopharmaceutics & Pharmacokinetics, McGraw-Hill/Appleton & Lange, ISBN 0071375503). For example, it is well within the skill of the art to start doses of the composition at levels lower than those required to achieve the desired therapeutic effect and to gradually increase the dosage until the desired effect is achieved. If desired, the effective daily dose may be divided into multiple doses for purposes of administration. Consequently, single dose compositions may contain such amounts or submultiples thereof to make up the daily dose. It will be understood, however, that the total daily usage of the compounds and compositions of the present disclosure will be decided by an attending physician within the scope of sound medical judgment.

Again, each of the states, diseases, disorders, and conditions, described herein, as well as others, can benefit from the compositions and methods described herein. Generally, treating a state, disease, disorder, or condition includes preventing, reversing, or delaying the appearance of clinical symptoms in a mammal that may be afflicted with or predisposed to the state, disease, disorder, or condition but does not yet experience or display clinical or subclinical symptoms thereof. Treating can also include inhibiting the state, disease, disorder, or condition, e.g., arresting or reducing the development of the disease or at least one clinical or subclinical symptom thereof. Furthermore, treating can include relieving the disease, e.g., causing regression of the state, disease, disorder, or condition or at least one of its clinical or subclinical symptoms. A benefit to a subject to be treated can be either statistically significant or at least perceptible to the subject or a physician.

Administration of a synthetic nucleic acid against KIF26B can occur as a single event or over a time course of treatment. For example, a synthetic nucleic acid against KIF26B can be administered daily, weekly, bi-weekly, or monthly. For treatment of acute conditions, the time course of treatment will usually be at least several days. Certain conditions could extend treatment from several days to several weeks. For example, treatment could extend over one week, two weeks, or three weeks. For more chronic conditions, treatment could extend from several weeks to several months or even a year or more.

Treatment in accord with the methods described herein can be performed prior to or before, concurrent with, or after conventional treatment modalities for pathologic calcification or bone formation.

A synthetic nucleic acid against KIF26B can be administered simultaneously or sequentially with another agent, such as an antibiotic, an anti-inflammatory, or another agent. For example, a synthetic nucleic acid against KIF26B can be administered simultaneously with another agent, such as an antibiotic or an anti-inflammatory. Simultaneous administration can occur through administration of separate compositions, each containing one or more of a synthetic nucleic acid against KIF26B, an antibiotic, an anti-inflammatory, or another agent. Simultaneous administration can occur through administration of one composition containing two or more of a synthetic nucleic acid against KIF26B, an antibiotic, an anti-inflammatory, or another agent. A synthetic nucleic acid against KIF26B can be administered sequentially with an antibiotic, an anti-inflammatory, or another agent. For example, a synthetic nucleic acid against KIF26B can be administered before or after administration of an antibiotic, an anti-inflammatory, or another agent.

Active compounds are administered at a therapeutically effective dosage sufficient to treat a condition associated with a condition in a patient. For example, the efficacy of a compound can be evaluated in an animal model system that may be predictive of efficacy in treating the disease in a human or another animal, such as the model systems shown in the examples and drawings.

An effective dose range of a therapeutic can be extrapolated from effective doses determined in animal studies for a variety of different animals. In general, a human equivalent dose (HED) in mg/kg can be calculated in accordance with the following formula (see e.g., Reagan-Shaw et al., FASEB J., 22(3):659-661, 2008, which is incorporated herein by reference):

$$HED(mg/kg) = \text{Animal dose(mg/kg)} \times (\text{Animal } K_m/\text{Human } K_m)$$

Use of the $K_m$ factors in conversion results in more accurate HED values, which are based on body surface area (BSA) rather than only on body mass. $K_m$ values for humans and various animals are well known. For example, the $K_m$ for an average 60 kg human (with a BSA of 1.6 m$^2$) is 37, whereas a 20 kg child (BSA 0.8 m$^2$) would have a $K_m$ of 25. $K_m$ for some relevant animal models are also well known, including: mice $K_m$ of 3 (given a weight of 0.02 kg and BSA of 0.007); hamster $K_m$ of 5 (given a weight of 0.08 kg and BSA of 0.02); rat $K_m$ of 6 (given a weight of 0.15 kg and BSA of 0.025) and monkey $K_m$ of 12 (given a weight of 3 kg and BSA of 0.24).

Precise amounts of the therapeutic composition depend on the judgment of the practitioner and are peculiar to each individual. Nonetheless, a calculated HED dose provides a general guide. Other factors affecting the dose include the physical and clinical state of the patient, the route of administration, the intended goal of treatment, and the potency, stability, and toxicity of the particular therapeutic formulation.

The actual dosage amount of a compound of the present disclosure or composition comprising a compound of the present disclosure administered to a subject may be determined by physical and physiological factors such as type of animal treated, age, sex, body weight, severity of condition, the type of disease being treated, previous or concurrent therapeutic interventions, idiopathy of the subject and on the route of administration. These factors may be determined by a skilled artisan. The practitioner responsible for administration will typically determine the concentration of active ingredient(s) in a composition and appropriate dose(s) for the individual subject. The dosage may be adjusted by the individual physician in the event of any complication.

In some embodiments, the synthetic nucleic acid against KIF26B may be administered in an amount from about 1 mg/kg to about 100 mg/kg, or about 1 mg/kg to about 50 mg/kg, or about 1 mg/kg to about 25 mg/kg, or about 1 mg/kg to about 15 mg/kg, or about 1 mg/kg to about 10 mg/kg, or about 1 mg/kg to about 5 mg/kg, or about 3 mg/kg. In some embodiments, a synthetic nucleic acid against KIF26B such as described herein may be administered in a range of about 1 mg/kg to about 200 mg/kg, or about 50 mg/kg to about 200 mg/kg, or about 50 mg/kg to about 100 mg/kg, or about 75 mg/kg to about 100 mg/kg, or about 100 mg/kg.

The effective amount may be less than 1 mg/kg/day, less than 500 mg/kg/day, less than 250 mg/kg/day, less than 100 mg/kg/day, less than 50 mg/kg/day, less than 25 mg/kg/day or less than 10 mg/kg/day. It may alternatively be in the range of 1 mg/kg/day to 200 mg/kg/day.

In other non-limiting examples, a dose may also comprise from about 1 microgram/kg/body weight, about 5 microgram/kg/body weight, about 10 microgram/kg/body weight, about 50 microgram/kg/body weight, about 100 microgram/kg/body weight, about 200 microgram/kg/body weight, about 350 microgram/kg/body weight, about 500 microgram/kg/body weight, about 1 milligram/kg/body weight, about 5 milligram/kg/body weight, about 10 milligram/kg/body weight, about 50 milligram/kg/body weight, about 100 milligram/kg/body weight, about 200 milligram/kg/body weight, about 350 milligram/kg/body weight, about 500 milligram/kg/body weight, to about 1000 mg/kg/body weight or more per administration, and any range derivable therein. In non-limiting examples of a derivable range from the numbers listed herein, a range of about 5 mg/kg/body weight to about 100 mg/kg/body weight, about 5 microgram/kg/body weight to about 500 milligram/kg/body weight, etc., can be administered, based on the numbers described above.

Pathologic Calcification and Bone Formation

One aspect of the present disclosure provides for methods of treating or preventing diseases, disorders, or conditions associated with pathologic calcification or pathologic bone formation. As described herein, administration of a synthetic nucleic acid targeting KIF26B inhibited osteogenesis and expression of osteogenic marker genes, leading to a reduction in ectopic calcification and formation of ossified nodules (see e.g., Example 1).

As an example, the methods described herein may be used to treat or prevent ectopic calcification. Ectopic calcification, also referred to as acquired calcification or intra-articular ectopic calcification, is an osteogenic process that leads to the formation of bone within intra-articular soft tissues. Ectopic calcification may result from osteogenesis after injury to a tissue (e.g., injury-induced) or after a surgical procedure (e.g., surgery-induced). As described herein, intra-articular ectopic calcification may appear as intra-articular nodules in the synovium or capsule of a joint. It can severely affect the joint and is often recalcitrant to therapy.

The methods described herein may be used to treat or prevent pathologic calcification or bone formation occurring within any joint or intra-articular space. For example, the joint can be a knee, elbow, hip, shoulder, neck, jaw, ankle, wrist, spine, finger, hand, ankle, toe, or foot joint.

As another example, the methods described herein may be used to treat or prevent heterotopic ossification, a form of calcification in soft tissues such as muscles and tendons. Heterotopic ossification may occur in response to musculoskeletal trauma, such as a fracture, arthroplasty, or other traumatic injury, or after a neurogenic injury such as a stroke or traumatic brain injury. Heterotopic ossification may occur at any site involved in a trauma or injury, but most commonly occurs, for example, at the elbow, thigh, pelvis, shoulder, head, neck, fingers, or skin.

Any disease, disorder, or condition mediated by pathologic calcification or pathologic bone formation may be treated or prevented using the methods described herein. For example, the disease, disorder, or condition may be pathologic osteogenesis, orthotopic ossification, osteoarthritis, osteosclerosis, spondyloarthropathy, diffuse idiopathic skeletal hyperostosis, crystal-induced arthropathies, ossification of the posterior longitudinal ligament, myositis ossificans, drug-induced ossification, fibrodysplasia ossificans progressive, synovial endochromatosis, hyperparathyroidism, para-articular ossification, or ochronosis.

Administration

Agents and compositions described herein can be administered according to methods described herein in a variety of means known to the art. The agents and composition can be used therapeutically either as exogenous materials or as endogenous materials. Exogenous agents are those produced or manufactured outside of the body and administered to the body. Endogenous agents are those produced or manufactured inside the body by some type of device (biologic or other) for delivery within or to other organs in the body.

As discussed above, administration can be intra-articular, parenteral, pulmonary, oral, topical, intradermal, intratumoral, intranasal, inhalation (e.g., in an aerosol), implanted, intramuscular, intraperitoneal, intravenous, intrathecal, intracranial, intracerebroventricular, subcutaneous, intranasal, epidural, intrathecal, ophthalmic, transdermal, buccal, and rectal.

In some preferred embodiments, administration can be intra-articular. As described herein, intra-articular delivery of KIF26B shRNA into the knee joint of an injury-induced ectopic calcification mouse model effectively suppressed the expression of KIF26B protein and reduced the number of calcified nodules.

Intra-articular delivery targets all cells within the synovial joint, so the therapeutic effect of the synthetic nucleic acid against KIF26B is not specific to any one cell type. For example, the synthetic nucleic acid may exert a therapeutic effect on progenitor cells, stem cells, ACL-derived progenitor cells, mesenchymal stem cells, myoblasts, stromal cells, pericytes, or immune cells.

Agents and compositions described herein can be administered in a variety of methods well known in the arts. Administration can include, for example, methods involving oral ingestion, direct injection (e.g., systemic or stereotactic), implantation of cells engineered to secrete the factor of interest, drug-releasing biomaterials, polymer matrices, gels, permeable membranes, osmotic systems, multilayer coatings, microparticles, implantable matrix devices, mini-osmotic pumps, implantable pumps, injectable gels and hydrogels, liposomes, micelles (e.g., up to 30 μm), nanospheres (e.g., less than 1 μm), microspheres (e.g., 1-100 μm), reservoir devices, a combination of any of the above, or other suitable delivery vehicles to provide the desired release profile in varying proportions. Other methods of controlled-release delivery of agents or compositions will be known to the skilled artisan and are within the scope of the present disclosure.

Delivery systems may include, for example, an infusion pump which may be used to administer the agent or composition in a manner similar to that used for delivering insulin or chemotherapy to specific organs or tumors. Typically, using such a system, an agent or composition can be administered in combination with a biodegradable, biocompatible polymeric implant that releases the agent over a controlled period of time at a selected site. Examples of polymeric materials include polyanhydrides, polyorthoesters, polyglycolic acid, polylactic acid, polyethylene vinyl acetate, and copolymers and combinations thereof. In addition, a controlled release system can be placed in proximity of a therapeutic target, thus requiring only a fraction of a systemic dosage.

Agents can be encapsulated and administered in a variety of carrier delivery systems. Examples of carrier delivery systems include microspheres, hydrogels, polymeric implants, smart polymeric carriers, and liposomes (see generally, Uchegbu and Schatzlein, eds. (2006) Polymers in Drug Delivery, CRC, ISBN-10: 0849325331). Carrier-based systems for molecular or biomolecular agent delivery can: provide for intracellular delivery; tailor biomolecule/agent release rates; increase the proportion of biomolecule that reaches its site of action; improve the transport of the drug to its site of action; allow colocalized deposition with other agents or excipients; improve the stability of the agent in vivo; prolong the residence time of the agent at its site of action by reducing clearance; decrease the nonspecific delivery of the agent to nontarget tissues; decrease irritation caused by the agent; decrease toxicity due to high initial doses of the agent; alter the immunogenicity of the agent; decrease dosage frequency; improve taste of the product; or improve shelf life of the product.

Kits

Also provided are kits. Such kits can include an agent or composition described herein and, in certain embodiments, instructions for administration. Such kits can facilitate performance of the methods described herein. When supplied as a kit, the different components of the composition can be packaged in separate containers and admixed immediately before use. Components include, but are not limited to synthetic nucleic acids against KIF26B, lentiviruses, or other expression vectors. Such packaging of the components separately can, if desired, be presented in a pack or dispenser device which may contain one or more unit dosage forms containing the composition. The pack may, for example, comprise metal or plastic foil such as a blister pack. Such packaging of the components separately can also, in certain instances, permit long-term storage without losing activity of the components.

Kits may also include reagents in separate containers such as, for example, sterile water or saline to be added to a lyophilized active component packaged separately. For example, sealed glass ampules may contain a lyophilized component and in a separate ampule, sterile water or sterile saline each of which has been packaged under a neutral non-reacting gas, such as nitrogen. Ampules may consist of any suitable material, such as glass, organic polymers, such as polycarbonate, polystyrene, ceramic, metal, or any other material typically employed to hold reagents. Other examples of suitable containers include bottles that may be fabricated from similar substances as ampules and envelopes that may consist of foil-lined interiors, such as aluminum or an alloy. Other containers include test tubes, vials, flasks, bottles, syringes, and the like. Containers may have a sterile access port, such as a bottle having a stopper that can be pierced by a hypodermic injection needle. Other containers may have two compartments that are separated by a readily removable membrane that upon removal permits the components to mix. Removable membranes may be glass, plastic, rubber, and the like.

In certain embodiments, kits can be supplied with instructional materials. Instructions may be printed on paper or another substrate, and/or may be supplied as an electronic-readable medium or video. Detailed instructions may not be physically associated with the kit; instead, a user may be directed to an Internet web site specified by the manufacturer or distributor of the kit.

A control sample or a reference sample as described herein can be a sample from a healthy subject or sample, a wild-type subject or sample, or from populations thereof. A reference value can be used in place of a control or reference sample, which was previously obtained from a healthy subject or a group of healthy subjects or a wild-type subject or sample. A control sample or a reference sample can also be a sample with a known amount of a detectable compound or a spiked sample.

Compositions and methods described herein utilizing molecular biology protocols can be according to a variety of standard techniques known to the art (see e.g., Sambrook and Russel (2006) Condensed Protocols from Molecular Cloning: A Laboratory Manual, Cold Spring Harbor Laboratory Press, ISBN-10: 0879697717; Ausubel et al. (2002) Short Protocols in Molecular Biology, 5th ed., Current Protocols, ISBN-10: 0471250929; Sambrook and Russel (2001) Molecular Cloning: A Laboratory Manual, 3d ed., Cold Spring Harbor Laboratory Press, ISBN-10: 0879695773; Elhai, J. and Wolk, C. P. 1988. Methods in Enzymology 167, 747-754; Studier (2005) Protein Expr Purif. 41(1), 207-234; Gellissen, ed. (2005) Production of Recombinant Proteins: Novel Microbial and Eukaryotic Expression Systems, Wiley-VCH, ISBN-10: 3527310363; Baneyx (2004) Protein Expression Technologies, Taylor & Francis, ISBN-10: 0954523253).

Definitions and methods described herein are provided to better define the present disclosure and to guide those of ordinary skill in the art in the practice of the present disclosure. Unless otherwise noted, terms are to be understood according to conventional usage by those of ordinary skill in the relevant art.

In some embodiments, numbers expressing quantities of ingredients, properties such as molecular weight, reaction conditions, and so forth, used to describe and claim certain embodiments of the present disclosure are to be understood as being modified in some instances by the term "about." In some embodiments, the term "about" is used to indicate that a value includes the standard deviation of the mean for the device or method being employed to determine the value. In some embodiments, the numerical parameters set forth in the written description and attached claims are approximations that can vary depending upon the desired properties sought to be obtained by a particular embodiment. In some embodiments, the numerical parameters should be construed in light of the number of reported significant digits and by applying ordinary rounding techniques. Notwithstanding that the numerical ranges and parameters setting forth the broad scope of some embodiments of the present disclosure are approximations, the numerical values set forth in the specific examples are reported as precisely as practicable. The numerical values presented in some embodiments of the present disclosure may contain certain errors necessarily resulting from the standard deviation found in their respective testing measurements. The recitation of ranges of values herein is merely intended to serve as a shorthand method of referring individually to each separate value falling within the range. Unless otherwise indicated herein, each individual value is incorporated into the specification as if it were individually recited herein. The recitation of discrete values is understood to include ranges between each value.

In some embodiments, the terms "a" and "an" and "the" and similar references used in the context of describing a particular embodiment (especially in the context of certain of the following claims) can be construed to cover both the singular and the plural, unless specifically noted otherwise. In some embodiments, the term "or" as used herein, including the claims, is used to mean "and/or" unless explicitly indicated to refer to alternatives only or the alternatives are mutually exclusive.

The terms "comprise," "have" and "include" are open-ended linking verbs. Any forms or tenses of one or more of these verbs, such as "comprises," "comprising," "has," "having," "includes" and "including," are also open-ended. For example, any method that "comprises," "has" or "includes" one or more steps is not limited to possessing only those one or more steps and can also cover other unlisted steps. Similarly, any composition or device that "comprises," "has" or "includes" one or more features is not limited to possessing only those one or more features and can cover other unlisted features.

All methods described herein can be performed in any suitable order unless otherwise indicated herein or otherwise clearly contradicted by context. The use of any and all examples, or exemplary language (e.g., "such as") provided with respect to certain embodiments herein is intended merely to better illuminate the present disclosure and does not pose a limitation on the scope of the present disclosure otherwise claimed. No language in the specification should be construed as indicating any non-claimed element essential to the practice of the present disclosure.

Groupings of alternative elements or embodiments of the present disclosure disclosed herein are not to be construed as limitations. Each group member can be referred to and claimed individually or in any combination with other members of the group or other elements found herein. One or more members of a group can be included in, or deleted from, a group for reasons of convenience or patentability. When any such inclusion or deletion occurs, the specification is herein deemed to contain the group as modified thus fulfilling the written description of all Markush groups used in the appended claims.

All publications, patents, patent applications, and other references cited in this application are incorporated herein by reference in their entirety for all purposes to the same extent as if each individual publication, patent, patent application, or other reference was specifically and individually indicated to be incorporated by reference in its entirety for all purposes. Citation of a reference herein shall not be construed as an admission that such is prior art to the present disclosure.

Having described the present disclosure in detail, it will be apparent that modifications, variations, and equivalent embodiments are possible without departing the scope of the present disclosure defined in the appended claims. Furthermore, it should be appreciated that all examples in the present disclosure are provided as non-limiting examples.

EXAMPLES

The following non-limiting examples are provided to further illustrate the present disclosure. It should be appreciated by those of skill in the art that the techniques disclosed in the examples that follow represent approaches the inventors have found function well in the practice of the present disclosure, and thus can be considered to constitute examples of modes for its practice. However, those of skill in the art should, in light of the present disclosure, appreciate that many changes can be made in the specific embodiments that are disclosed and still obtain a like or similar result without departing from the spirit and scope of the present disclosure.

Example 1: Kif26B Silencing Prevents Osseous Transdifferentiation of Progenitor/Stem Cells and Attenuates Ectopic Calcification in a Murine Model This Example describes how inhibition of KIF26B attenuates ectopic calcification.

Abstract

Ectopic calcification is an osteogenic process that leads to the formation of inappropriate bone within intra-articular soft tissues, often in response to injury or surgery. The molecular mechanisms governing this phenotype have yet to be determined. Using a population genetics approach, described herein is the association of the kinesin superfamily member 26b (Kif26b) with injury-induced ectopic calcification through quantitative trait locus analysis of recombinant inbred mouse strains, consistent with a genome-wide association study that identified KIF26B as a severity locus for ectopic calcification in patients with hip osteoarthritis. Despite these associations of KIF26B with ectopic calcification, its mechanistic role and functional implications have not yet been fully elucidated. Herein is described the functional role of KIF26B in osseous and chondrogenic transdifferentiation of human and murine progenitor/stem cells and in a murine model of non-invasive injury-induced intra-articular ectopic calcification. KIF26B ablation via lentivirus-mediated shRNA significantly arrested osteogenesis of progenitor/stem cells and suppressed the expression of typical osteogenic marker genes. Conversely, KIF26B loss-of-function increased chondrogenesis as demonstrated by enhanced Safranin-O staining and by the elevated expression of chondrogenic marker genes. Furthermore, cell function analysis revealed that KIF26B knockdown significantly decreased cell viability and proliferation and induced cellular apoptosis Mechanistically, loss of osteogenesis was reverted by the addition of a Wnt agonist, SKL2001, demonstrating a role of KIF26B in canonical Wnt/β-catenin signaling. Finally, intraarticular delivery of Kif26b shRNA in B6-129SF2/J mice significantly hampered the development of intra-articular ectopic calcification at 8 weeks after injury compared to mice treated with non-target scrambled shRNA. In summary, these observations highlight that KIF26B plays a crucial role in ectopic bone formation by repressing osteogenesis, but not chondrogenesis, potentially via modulating Wnt/β-catenin signaling. These findings establish KIF26B as a critical determinant of the osteogenic process in pathologic endochondral bone formation and an actionable target for pharmacotherapy to mitigate ectopic calcification (and heterotopic ossification).

Introduction

The term ectopic bone—from the Greek word ektopos meaning "away from a place"—is when non-skeletal soft tissues become bone-like (1). Most often, ectopic or acquired calcification results from osteogenesis following direct injury to a tissue (2-4). Ectopic calcification as referred to herein appears as multiple intra-articular nodules in the synovium and joint capsule. It can severely affect the joint and is often recalcitrant to therapy. The incidence of ectopic calcification remains unknown but is not rare. Heterotopic ossification, a form of calcification in soft tissues such as muscles and tendons, has been extensively studied in different contexts and for which the molecular mechanisms have been better understood (5-8). Intra-articular ectopic calcification, however, has not been studied and characterized as well. Although it is thought that the molecular mechanisms that govern physiological calcification of skeletal tissues are akin to those regulating pathological or ectopic calcification of soft tissues (9), clear knowledge gaps still exist when it comes to understanding the etiopathogenesis of ectopic calcification.

Described herein is a population genetics approach to identifying genes involved in ectopic calcification using an advanced intercross of two informative mouse strains: LG/J (Large), a healer strain with a higher predisposition for developing ectopic calcification, and SM/J (Small), a non-healer strain with a lower susceptibility for developing ectopic calcification (4,10-13). Twenty quantitative trait loci (QTLs) influencing ectopic bone formation subsequent to knee trauma were identified in the advanced intercross line randomly mated for 44 generations (4). The high degree of parental line recombination permitted precise single nucleotide polymorphism mapping to sub-centimorgan intervals containing small sets of candidate genes for the causal genetic factors in synovial ectopic bone formation (4). Within these QTLs, Kif26b was identified as a prime candidate related to ectopic calcification. Furthermore, a genome-wide association study of heterotopic ossification in patients after total hip arthroplasty for osteoarthritis has identified KIF26B as a gene associated with heterotopic ossification severity (14).

KIF26B is a member of the kinesin superfamily of proteins, which are involved in the microtubule and ATP-dependent transport of various cargos to a specific destination (15). Moreover, studies have shown that Kif26b controls endothelial cell polarity, which is tied to non-canonical Wnt signaling (16) and its expression is increased as cells differentiate into chondrocytes (17). More recently, Kif26b has been tested for a role in osseous transdifferentiation of mouse myoblasts (14). Despite its implication in ectopic calcification in mice and patients, the mechanistic role, and functional implications of KIF26B have not yet been fully elucidated.

The purpose of the present study is to advance understanding of the role of KIF26B in ectopic calcification by examining the effects of KIF26B knockdown on osteogenic or chondrogenic differentiation of progenitor/stem cells in vitro as well as in an injury-induced ectopic calcification model of anterior cruciate ligament (ACL) rupture in mice. In addition, mechanistic insights are described to understand the role of KIF26B in Wnt signaling and cell processes such as proliferation and apoptosis that highlight the potential of KIF26B as a mechanistic target in the treatment of ectopic calcification and possibly for other forms of pathological bone formation such as heterotopic ossification.

Materials and Methods

Ethics Statement

Figure 1A:
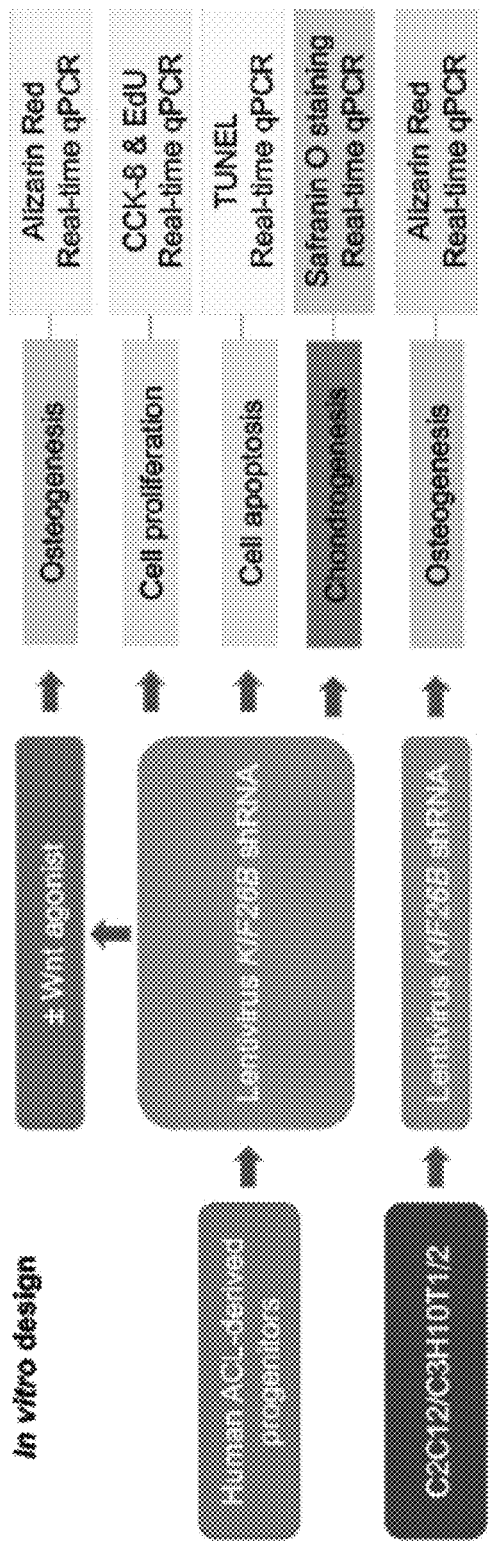
FIG. 1A-FIG. 1B. Study design. A. In vitro studies were performed using human ACLp cells, murine C2C12, or C3H10T1/2 cells. Cells were transduced with a scrambled shRNA or KIF26B shRNA. Osteogenesis was induced by osteogenesis differentiation medium in all cell types. Osteogenesis was detected by Alizarin red staining and the expression of osteogenic marker genes was measured by RT-qPCR. Chondrogenesis was induced by chondrogenic medium in ACLp cells in a pellet culture system. Successful chondrogenesis was ascertained by measuring the expression of chondrogenic marker genes and by Safranin-O staining. The mechanistic role of KIF26B knockdown was studied in osteogenic differentiation of ACLp cells in the presence and absence of Wnt agonist II, SKL2001. Cell proliferation was studied by CCK-8 assay and EdU staining while apoptosis was detected by TUNEL. B. In vivo experiments were conducted in male B6-129SF2/J mice. Mice received either scrambled shRNA or Kif26b shRNA injection in the knee joint after which knees were subjected to non-invasive mechanical loading to instigate intra-articular ectopic calcification. Ectopic calcification was analyzed at 4- and 8-weeks post-loading using micro-CT. Histology was performed to visualize and stain the nodules with Safranin O staining.
Figure 1B:
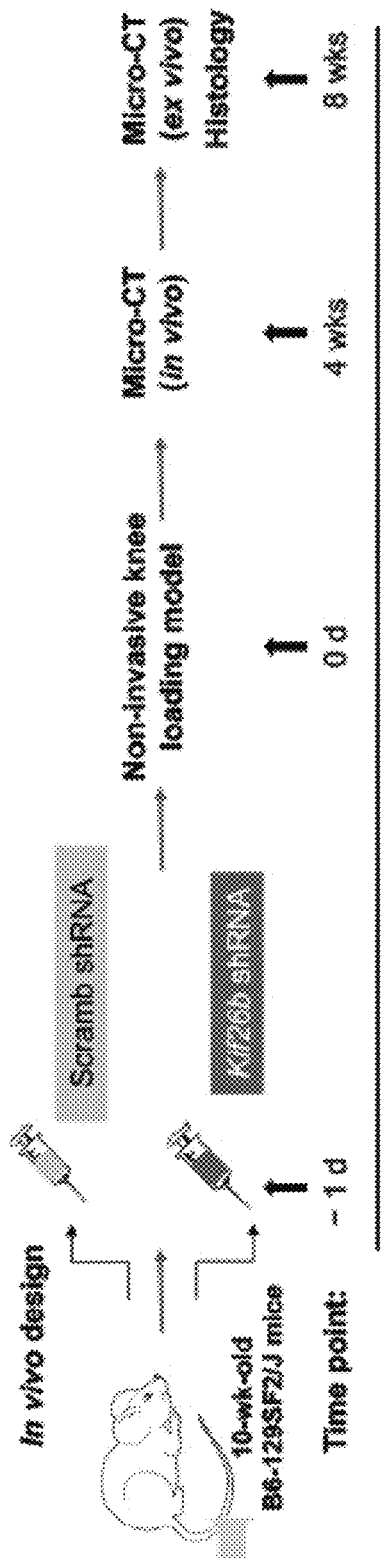

The utilization of discarded ACL tissues from patients undergoing ACL reconstruction surgery was approved by the Washington University Institutional Review Board (Protocol No. 201104119). All patients provided written and signed informed consent prior to operation. Animal experiments described in this manuscript were approved by the Institutional Animal Care and Use Committee of Washington University (Protocol No. 20190113). An overview of the study design is displayed in FIG. 1A-FIG. 1B.

Cell Culture

Progenitor cells were derived from human ACL and termed as ACLp cells (18). ACLp cells were chosen as clinically relevant intra-articular cells that possess characteristics of mesenchymal stromal cells, i.e., they exhibit the potential to become chondrocytes, osteoblasts, and adipocytes after specific cues (19). Briefly, ACL fragments were collected from patients (n=53) undergoing ACL reconstruction surgery (see e.g., TABLE 1) and were transported to the laboratory in sterile sealed containers containing Dulbecco's phosphate-buffered saline (DPBS, Gibco).

TABLE 1

Characteristics of patients from which ACL progenitor cells were collected and analyzed.

Figure 2A:
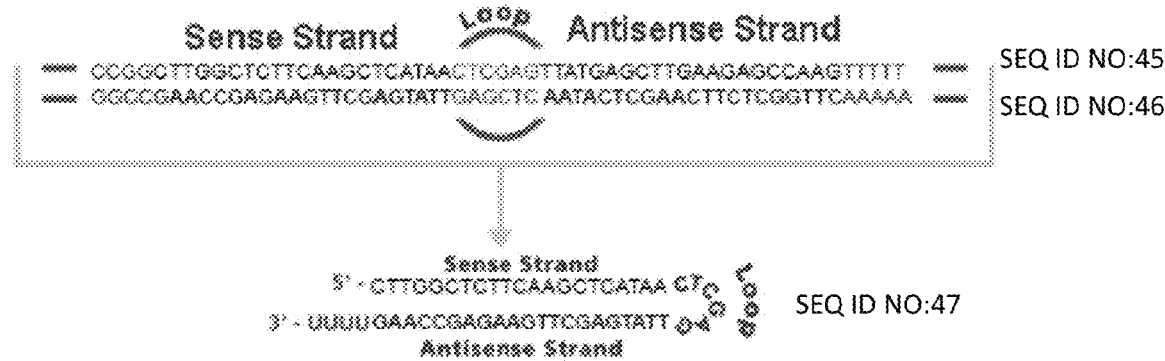
FIG. 2A-FIG. 2G. Construction and characterization of lentivirus KIF26B shRNA. A. Human forward/reverse DNA sequences (SEQ ID NOS:45-46) and corresponding shRNA sequence (SEQ ID NO:47) targeting KIF26B are shown. B. Mouse forward/reverse DNA sequences (SEQ ID NOS:48-49) and corresponding shRNA sequence (SEQ ID NO:50) targeting KIF26B are shown. C. KIF26B mRNA expression was significantly decreased in ACLp (n=3) cells transduced with KIF26B shRNA compared with scrambled shRNA at the 24-hour time point (Mann-Whitney test). D. After 72 hours of transduction with scrambled shRNA or KIF26B shRNA, KIF26B protein was also reduced in ACLp cells (n=3) treated with KIF26B shRNA compared with scrambled shRNA as shown by representative blots. E. Quantification of Western blot signal intensity revealed that KIF26B protein expression was significantly less in cells treated with KIF26B shRNA compared with those transduced with scrambled shRNA (Unpaired t-test). F-G. After 24 hours of transduction with Kif26b shRNA or scrambled shRNA, Kif26b mRNA expression was significantly decreased in C3H10T1/2 (n=4) (F) and C2C12 cells (n=3) (G) transduced with Kif26b shRNA compared with scrambled shRNA (Mann-Whitney test).
Figure 2B:
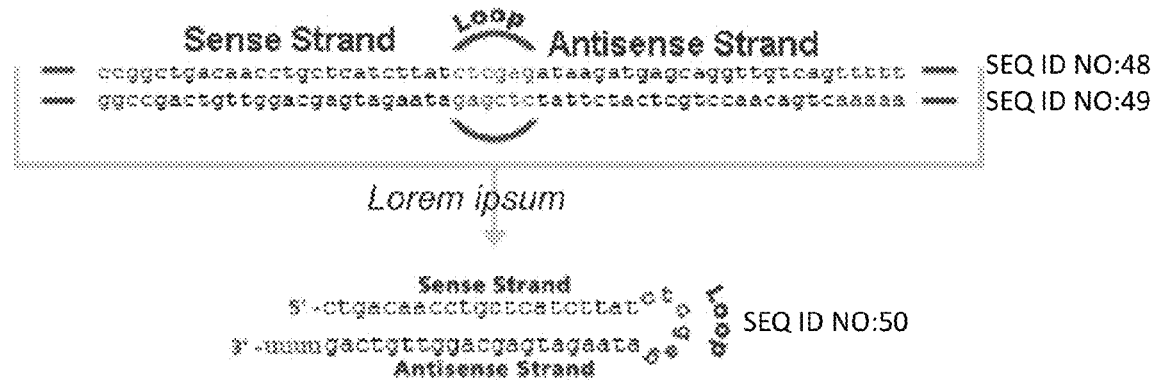
Figure 2C:
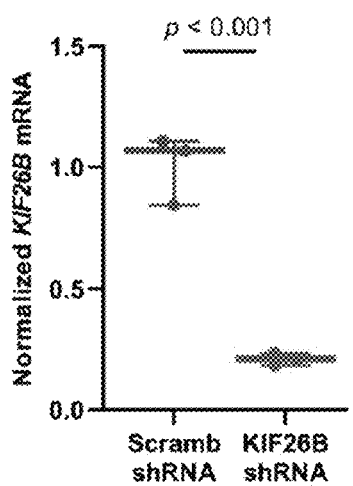
Figure 2D:
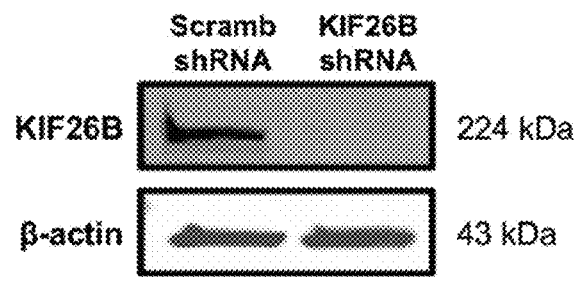
Figure 2E:
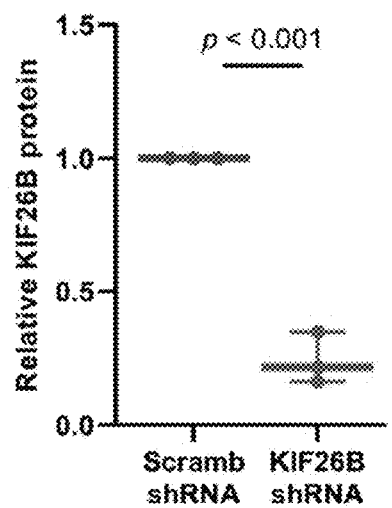
Figure 3A:
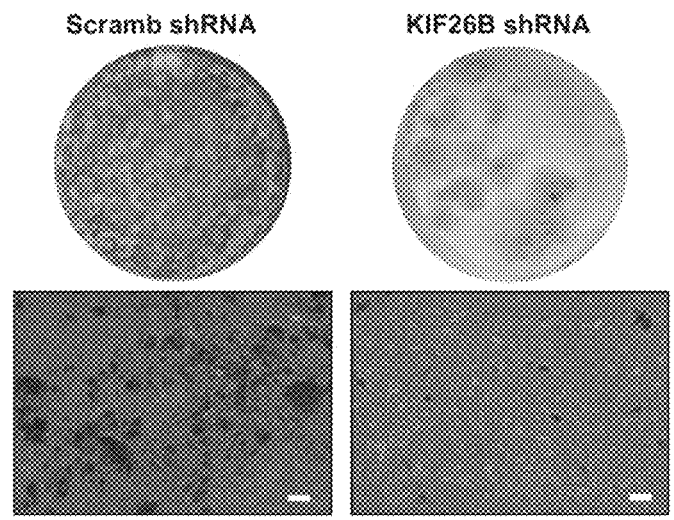
FIG. 3A-FIG. 3D. KIF26B silencing attenuates osteogenesis in ACLp cells. A. KIF26B knockdown significantly arrested matrix mineralization of ACLp cells (n=6) compared to scrambled shRNA as shown by macro and microphotographs of Alizarin red-stained cells (scale bar=100 μm). B-D. mRNA expression of typical osteogenic marker genes namely RUNX2 (B), ALPL (C), and BGLAP (D) was significantly decreased in cells transduced with KIF26B shRNA (n=6) compared with those transduced with scrambled shRNA (n=6) (Mann-Whitney test).
Figure 3B:
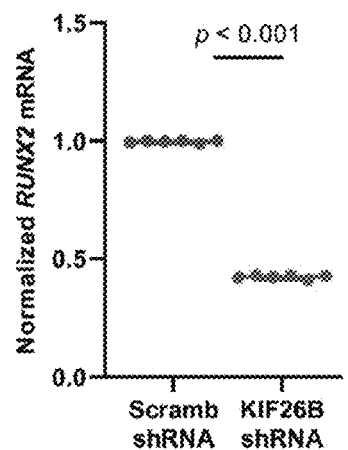
Figure 3C:
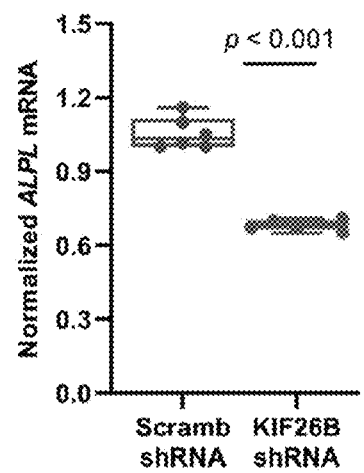
Figure 3D:
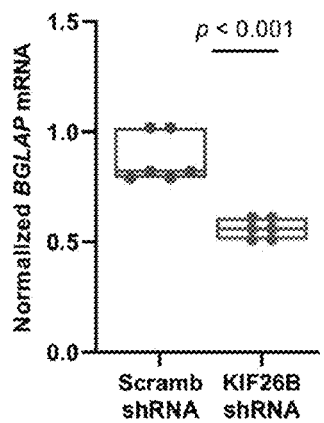
Figure 6A:
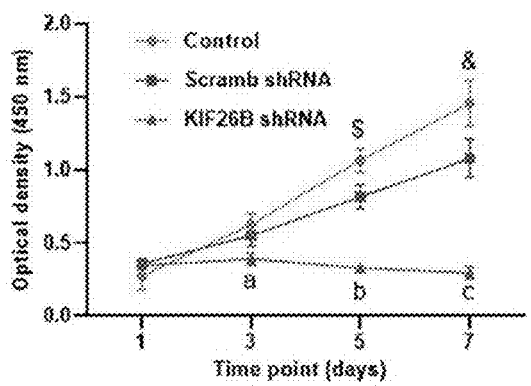
FIG. 6A-FIG. 6E. Loss of KIF26B decreases the number of living cells and proliferation. A. KIF26B knockdown significantly reduced the number of living ACLp cells (n=4) compared with scrambled shRNA and untreated control groups as determined by CCK-8 assay. $ and &: statistically significant differences between scrambled shRNA and control groups with p=0.011 and p=0.025, respectively; a, b, and c: statistically significant differences between scrambled shRNA and KIF26B shRNA groups with all p<0.05 (2-way ANOVA with Šídák's multiple comparison test). B. After 72 hours of transduction with scrambled shRNA or KIF26B shRNA, the EdU incorporation assay for measuring cell proliferation showed that KIF26B knockdown decreased the numbers of EdU positive cells as displayed in immunofluorescence images (n=3 each). Blue=Hoechst 3342; Green=EdU, scale bar=100 μm. C. Quantification of cell numbers revealed a significantly reduced fraction of EdU positive cells compared to both untreated control and scrambled shRNA groups (1-way analysis of variance with Tukey's post hoc test). D-E. mRNA expression of cell proliferation markers namely PCNA (D), and XRCC2 (E) was significantly decreased in cells treated with KIF26B shRNA (n=6) and compared to both untreated control and scrambled shRNA groups (n=6 each) (Kruskal-Wallis with Dunn's multiple comparison test).
Figure 6B:
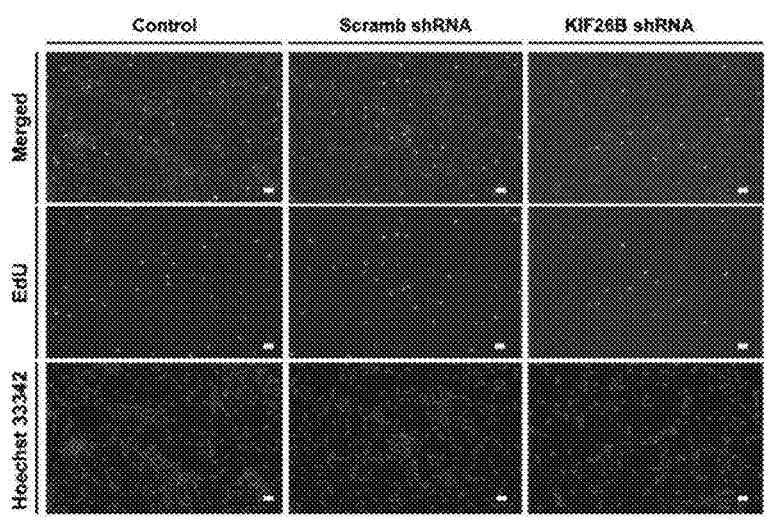
Figure 6C:
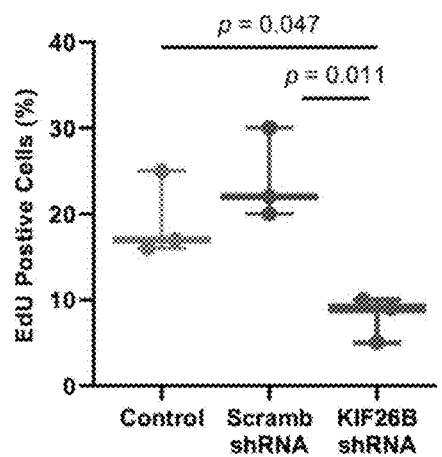
Figure 6D:
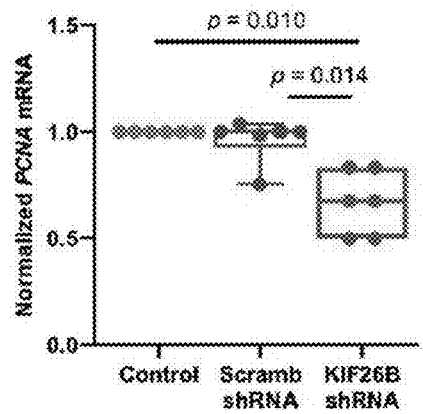
Figure 6E:
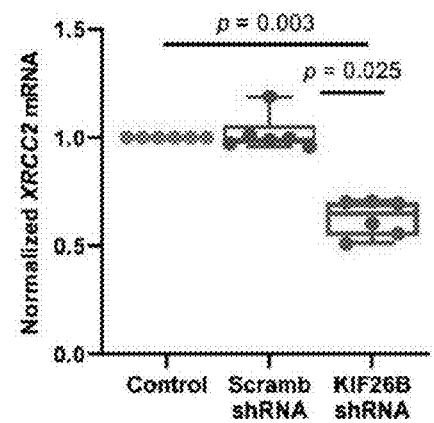
Figure 7A:
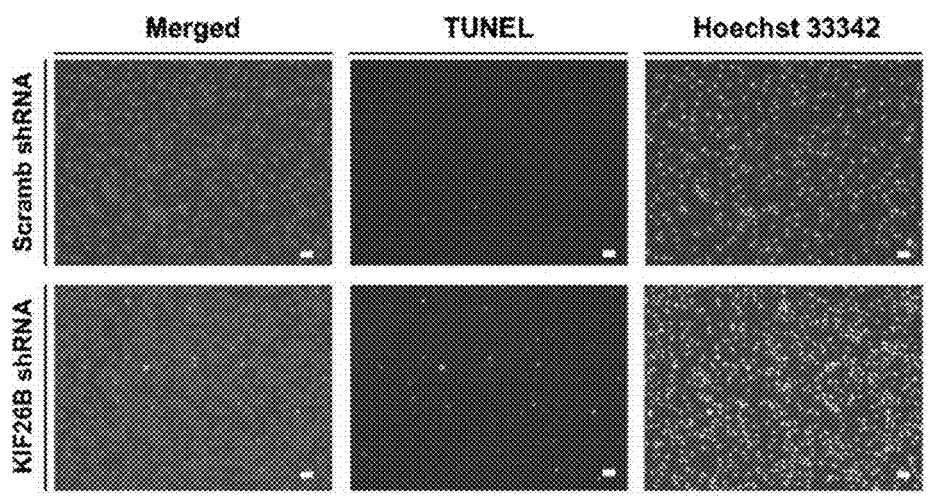
FIG. 7A-FIG. 7E. Loss of KIF26B induces cellular apoptosis. A. After 72 hours of transduction with scrambled shRNA or KIF26B shRNA, KIF26B knockdown increased the number of TUNEL positive cells as measured by TUNEL assay compared to the scrambled shRNA group (n=4 each). Blue=Hoechst 3342; Green=TUNEL, scale bar=100 μm. B. Quantification revealed that the percentage of TUNEL-positive cells was significantly higher in the KIF26B shRNA group compared to the scrambled shRNA group (Unpaired t-test). C-E. mRNA expression of pro-apoptotic gene BAX (C) was significantly higher in cells treated with KIF26B shRNA compared to the scrambled shRNA group while mRNA expression of anti-apoptotic gene BCL2 (D) was significantly lower in cells treated with KIF26B shRNA. BAX/BCL2 ratio (E) was significantly higher in cells treated with KIF26B shRNA than those treated with scrambled shRNA (n=6 each) (Mann-Whitney test).
Figure 7B:
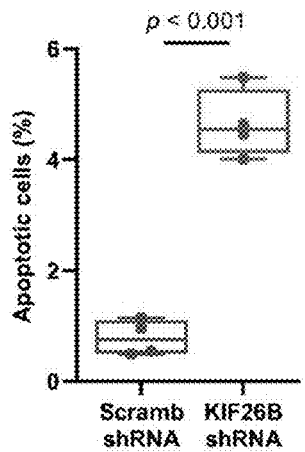
Figure 7C:
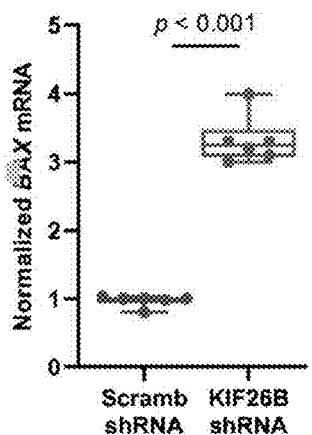
Figure 7D:
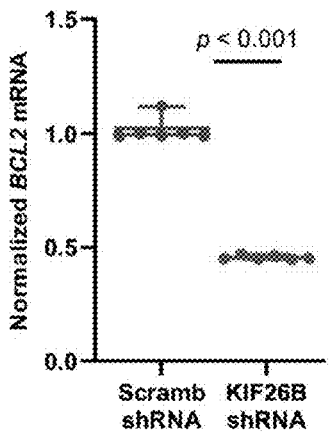
Figure 7E:
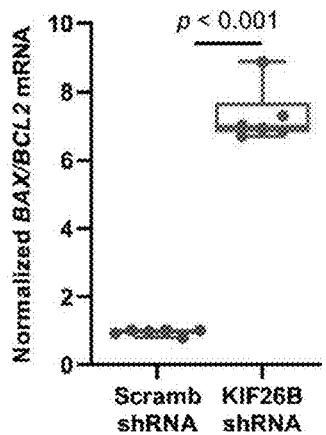
Figure 8A:
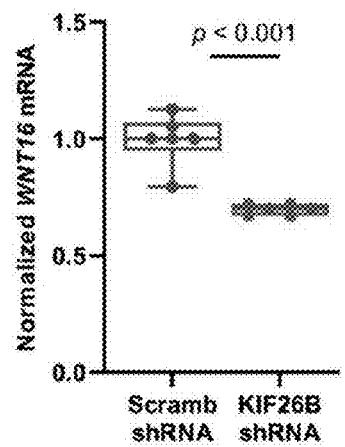
FIG. 8A-FIG. 8E. Modulation of canonical Wnt/β-catenin signaling by KIF26B. A-B. KIF26B knockdown suppressed mRNA expression of Wnt/β-catenin pathway genes namely WNT16 (A) and AXIN2 (B) compared with scrambled shRNA (n=6 each) (Mann-Whitney test). C. After 7 days of osteogenic induction, representative Western blot images showed the expression of non-phosphorylated (active) β-catenin at Ser33/37/Thr41 and total β-catenin in ACLp cells (n=4) transduced with either KIF26B shRNA or scrambled shRNA. D-E. Quantification of Western blot signaling intensity revealed that both active β-catenin (D)
Figure 8B:
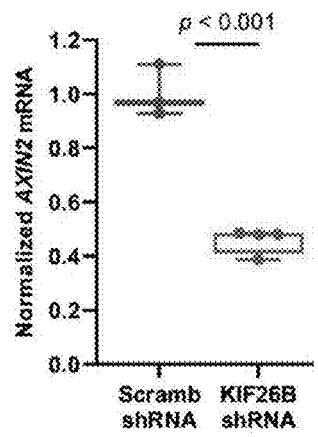
Figure 8C:
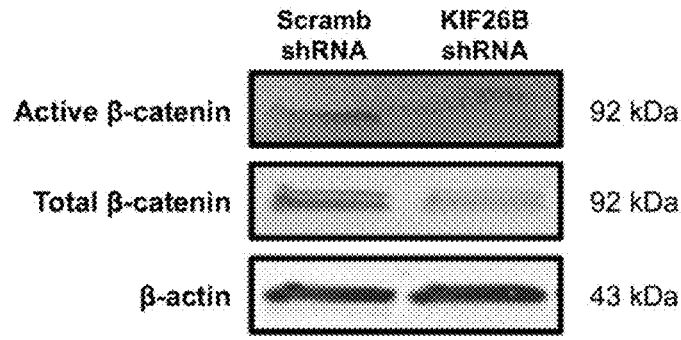
Figure 8D:
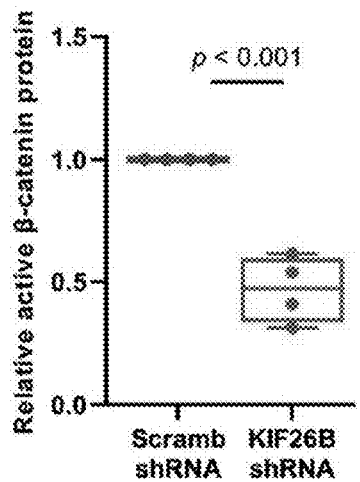
Figure 8E:
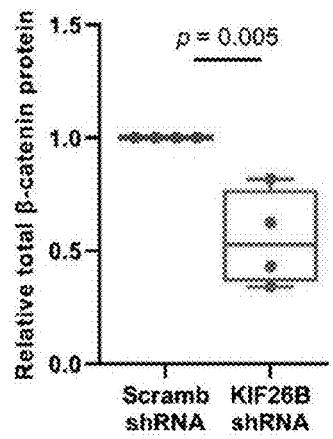
Figure 9A:
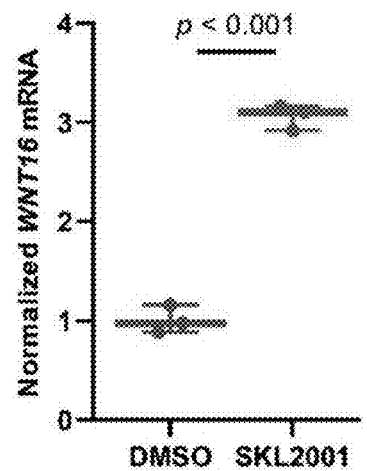
Figure 9B:
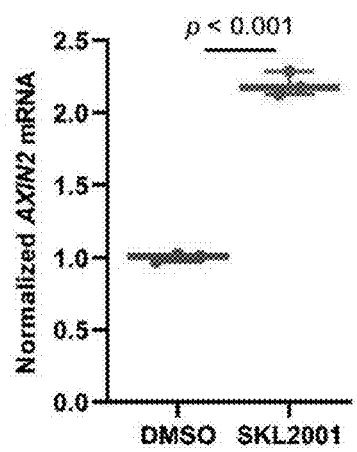
Figure 9C:
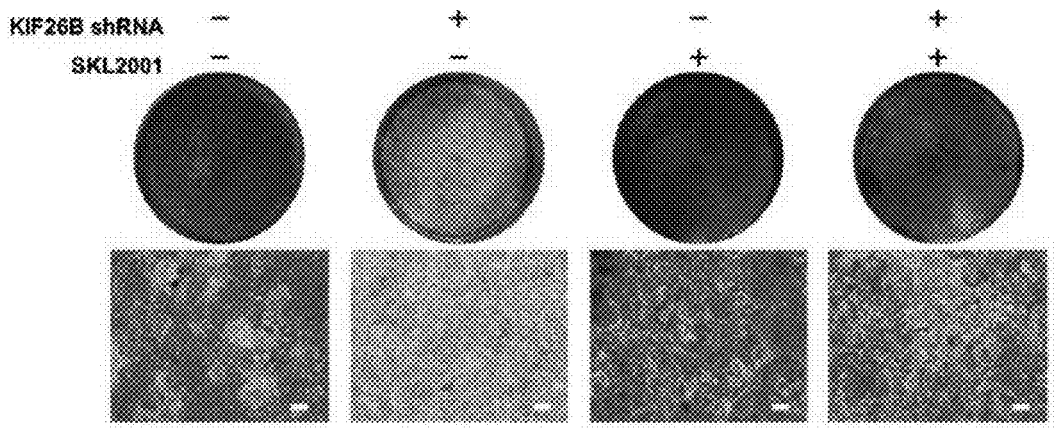
Figure 9D:
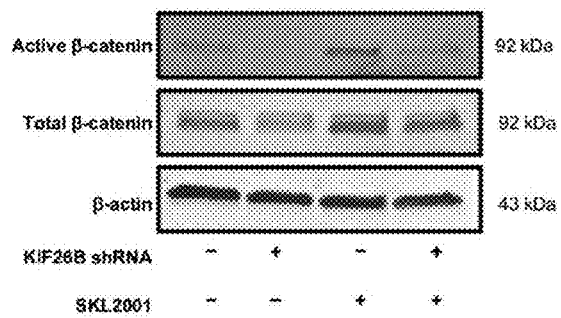
Figure 9E:
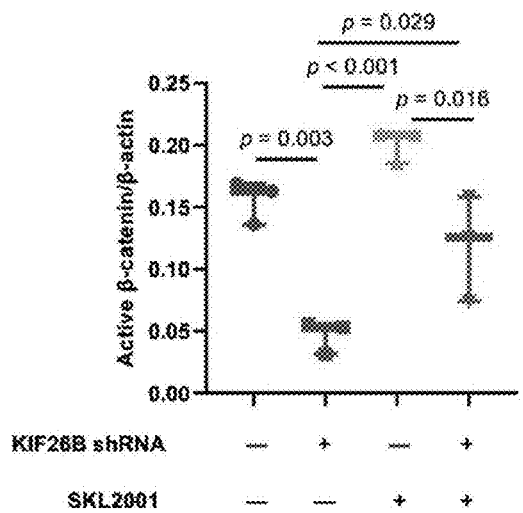
Figure 9F:
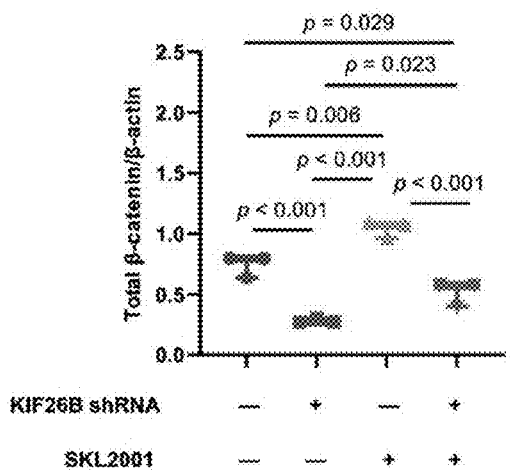
Figure 12A:
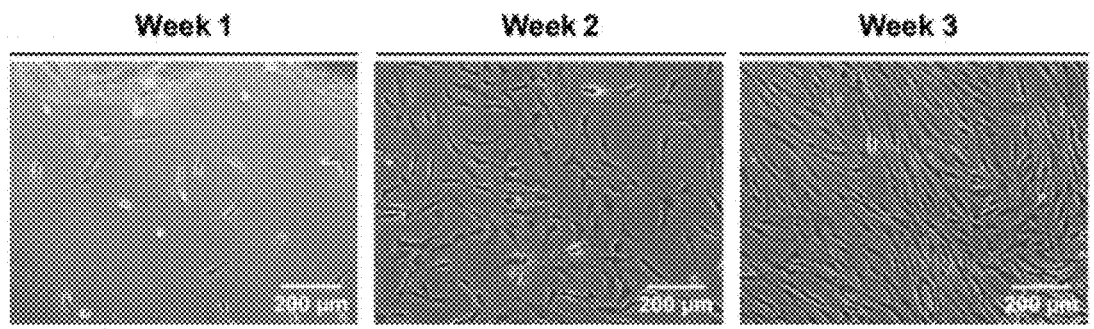
Figure 12B:
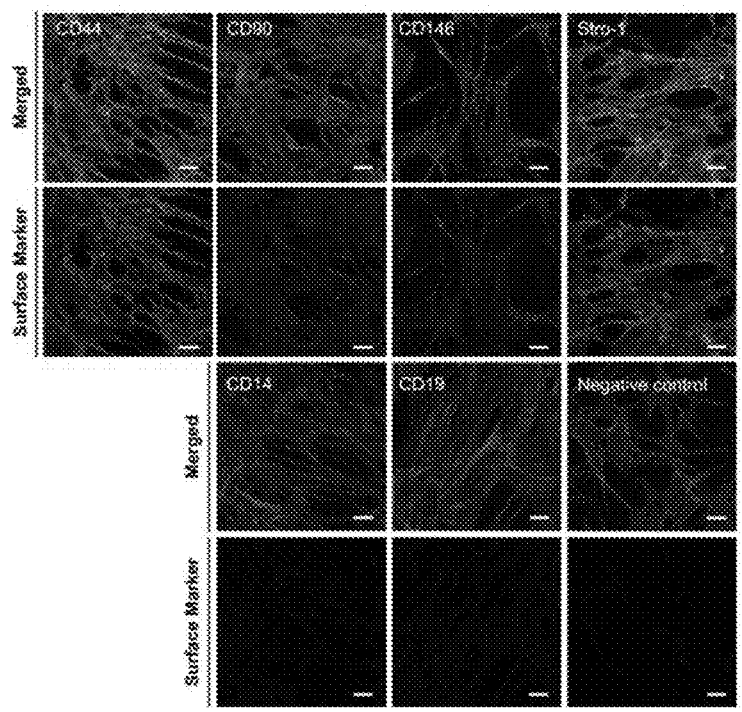
Figure 12C:
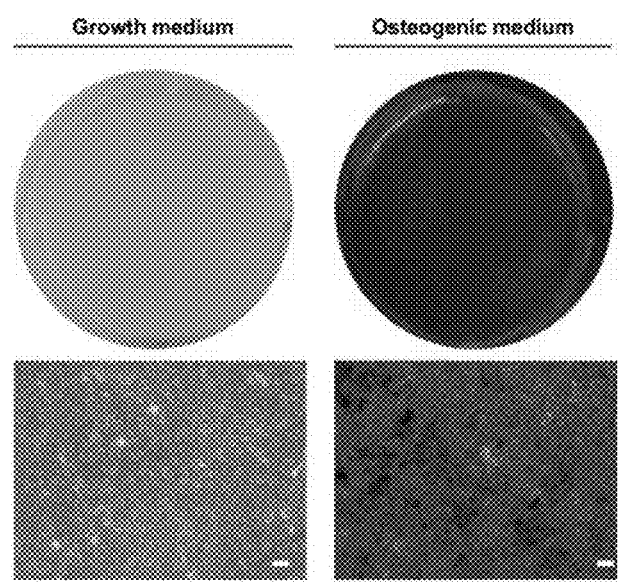
Figure 12D:
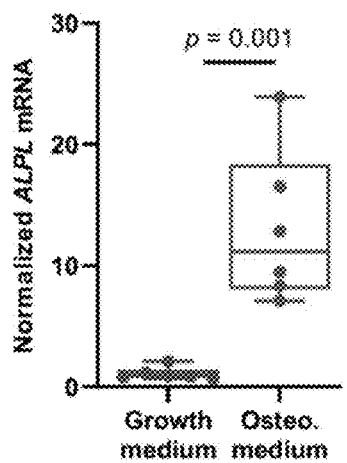

| Patient No. | Age (year) | Sex | Experiment | Data in |
|---|---|---|---|---|
| P15-063 | 15 | Female | RT-qPCR | FIG. 2C |
| P15-064 | 19 | Male | RT-qPCR | FIG. 2C |
| P15-065 | 16 | Male | RT-qPCR | FIG. 2C |
| P15-066 | 13 | Female | Western blot | FIG. 2D-FIG. 2E |
| P15-067 | 16 | Female | Western blot | FIG. 2D-FIG. 2E |
| P15-068 | 47 | Male | Western blot | FIG. 2D-FIG. 2E |
| P15-031 | 15 | Female | Cell egression | FIG. 12A |
| P15-032 | 34 | Female | Cell egression | FIG. 12A |
| P15-033 | 25 | Male | Cell egression | FIG. 12A |
| P15-070 | 21 | Female | Immunostaining, ARS | FIG. 12B-FIG. 12C |
| P15-071 | 18 | Male | Immunostaining, ARS | FIG. 12B-FIG. 12C |
| P15-072 | 19 | Female | Immunostaining, ARS | FIG. 12B-FIG. 12C |
| P15-069 | 40 | Female | ARS, RT-qPCR | FIG. 12D |
| P15-073 | 19 | Female | ARS, RT-qPCR | FIG. 12D |
| P15-075 | 50 | Male | ARS, RT-qPCR | FIG. 12D |
| P15-077 | 19 | Female | ARS, RT-qPCR | FIG. 12D |
| P15-078 | 44 | Female | ARS, RT-qPCR | FIG. 12D |
| P15-079 | 60 | Female | ARS, RT-qPCR | FIG. 12D |
| P15-080 | 33 | Female | ARS, RT-qPCR | FIG. 3A-FIG. 3D |
| P15-081 | 23 | Male | ARS, RT-qPCR | FIG. 3A-FIG. 3D |
| P15-082 | 17 | Male | ARS, RT-qPCR | FIG. 3A-FIG. 3D |
| P15-083 | 15 | Male | ARS, RT-qPCR | FIG. 3A-FIG. 3D |
| P15-084 | 20 | Male | RT-qPCR | FIG. 3B-FIG. 3D |
| P15-085 | 34 | Male | RT-qPCR | FIG. 3B-FIG. 3D |
| P15-113 | 46 | Male | RT-qPCR | FIG. 5A-FIG. 5E |
| P15-114 | 37 | Male | RT-qPCR, S-O staining | FIG. 5A-FIG. 5G |
| P15-086 | 33 | Female | CCK-8, EdU, RT-qPCR | FIG. 6A-FIG. 6E |
| P16-115 | 27 | Female | RT-qPCR, S-O staining | FIG. 5A-FIG. 5G |
| P15-116 | 39 | Male | RT-qPCR, S-O staining | FIG. 5A-FIG. 5G |
| P15-087 | 36 | Female | CCK-8, EdU, RT-qPCR | FIG. 6A-FIG. 6E |
| P15-088 | 14 | Male | CCK-8, EdU, RT-qPCR | FIG. 6A-FIG. 6E |
| P15-089 | 40 | Male | RT-qPCR | FIG. 6D-FIG. 6E |
| P15-090 | 25 | Male | RT-qPCR | FIG. 6D-FIG. 6E |
| P15-091 | 43 | Male | RT-qPCR | FIG. 6D-FIG. 6E |
| P15-092 | 53 | Female | TUNEL, RT-qPCR | FIG. 7A-FIG. 7E |
| P15-093 | 45 | Male | TUNEL, RT-qPCR | FIG. 7A-FIG. 7E |
| P15-094 | 16 | Male | TUNEL, RT-qPCR | FIG. 7A-FIG. 7E |
| P15-095 | 19 | Female | TUNEL, RT-qPCR | FIG. 7A-FIG. 7E |
| P15-096 | 18 | Female | RT-qPCR | FIG. 7C-FIG. 7E |
| P15-097 | 45 | Male | RT-qPCR | FIG. 7C-FIG. 7E |
| P15-098 | 18 | Female | RT-qPCR | FIG. 8A-FIG. 8B, FIG. 9A-FIG. 9B |
| P15-099 | 21 | Male | RT-qPCR | FIG. 8A-FIG. 8B, FIG. 9A-FIG. 9B |
| P15-101 | 55 | Female | RT-qPCR | FIG. 8A-FIG. 8B, FIG. 9A-FIG. 9B |
| P15-102 | 36 | Female | RT-qPCR, Western blot | FIG. 8A-FIG. 8E |
| P15-103 | 16 | Female | RT-qPCR, Western blot | FIG. 8A-FIG. 8E |
| P15-104 | 22 | Female | RT-qPCR, Western blot | FIG. 8A-FIG. 8E |
| P15-105 | 23 | Female | Western blot | FIG. 8C-FIG. 8E |
| P15-106 | 40 | Female | ARS | FIG. 9C |
| P15-107 | 16 | Female | ARS | FIG. 9C |
| P15-108 | 16 | Female | ARS | FIG. 9C |
| P15-110 | 30 | Female | Western blot | FIG. 9D-FIG. 9F |
| P15-111 | 16 | Male | Western blot | FIG. 9D-FIG. 9F |
| P15-112 | 16 | Female | Western blot | FIG. 9D-FIG. 9F |

ACL = anterior cruciate ligament;
RT-qPCR = real-time polymerase chain reaction;
ARS = Alizarin red staining;
S-O = Safranin-O;
CCK-8 = Cell Counting Kit 8;
EdU = 5-ethynyl-2'-deoxyuridine;
TUNEL = terminal deoxynucleotidyl transferase (TdT)-mediated dUTP nick-end labelling.

Fragments were washed twice with DPBS, and further diced into 3-4 mm$^3$ pieces. Explants were cultured in 6 well-plates containing Dulbecco's Modified Eagle Medium/Nutrient Mixture F-12 (DMEM/F-12, Gibco) with high glucose (4.5 g/L glucose) and 6 mM L-glutamine and supplemented with 10% fetal bovine serum (FBS, Gibco) and 1% penicillin/streptomycin (100 units/mL and 100 µg/mL respectively, Gibco). Cells were allowed to egress from explants for 3 weeks when explants were removed, and cells were grown in standard culture medium and under ordinary culture conditions. At ~80% confluence, cultures were washed with 1×PBS to remove non-adherent materials, and then adherent cells were dissociated by exposure to 0.5% trypsin ethylenediaminetetraacetic acid (Thermo Fisher Scientific), living cells were counted using a hemocytometer and trypan blue exclusion dye. In addition, cultures of murine C2C12 (in-house) and C3H10T1/2 cells were established. C2C12 is a mouse-derived myoblast cell line (20), generated as a subclone of the C2 cell line (21)). The C3H10T1/2 cell line (22) has been shown to display fibroblastic morphology in cell culture and is functionally akin to mesenchymal stem cells (23). Both cell types have been shown to undergo osteogenesis upon osteogenic induction (24,25).

Characterization of ACLp Cells

In order to characterize ACLp cells, immunofluorescent staining for several stromal cell markers was performed using Human Mesenchymal Stem Cell Characterization Kit (EMD Millipore). This kit contains a panel of positive and negative selection markers for the characterization of the mesenchymal stromal cell population. In brief, 3×10$^5$ ACLp cells were directly seeded on the Nunc Lab-Tek Chamber Slides (Thermo Fisher Scientific) and cultured for 3 days. Slides were blocked in 10% normal donkey serum (NDS) in PBS at room temperature for 2 hours. After draining off the blocking buffer, slides were incubated with the primary antibodies for respective cell surface markers at 1:200 dilution using 2% NDS in PBS. Mouse IGg was used as a negative control. Slides were incubated at 4° C. overnight followed by 3 times washes with 1×PBS. Donkey anti-mouse secondary antibody was used (ab150105, Abcam) at 1:200 dilution using 2% NDS in PBS. Phalloidin-iFluor 594 (ab176757, Abcam) was used at 1:500 dilution. Slides were incubated at room temperature for 60 minutes. Finally, the slides were rinsed with PBS before being sealed with VECTASHIELD® antifade mounting medium with 4',6-diamidino-2-phenylindole (DAPI, Vector Laboratories). Images were taken with Zeiss LSM 880 II Airyscan FAST Confocal Microscope (Zeiss). ACLp cells were also tested for their potential to transdifferentiate into osteoblasts and chondrocytes as described in subsequent sections.

Lentivirus Construction, Production, and Purification

The following shRNA sequences were used to target and silence KIF26B mRNA in *Homo sapiens* 5'-CTTGGCTCTTCAAGCTCATAACTCGAGTTAT-GAGCTTGAAGAGCCAAGTTTT T-3' (SEQ ID NO: 1) and 5'-ctgacaacctgctcatcttatctcgagataagat-gagcaggttgtcagttttt-3' (SEQ ID NO: 2) in *Mus musculus*. Sequences were chemically generated by Thermo Fisher Scientific. The shRNA oligonucleotides were annealed and inserted between the AgeI and EcoRI (New England Bio-Labs) sites of the recombinant lentivirus expression plasmid (pLKO-1-TRC, Addgene). Scrambled shRNA that did not target any known mRNA, was used as a negative control (termed scrambled shRNA). Accurate insertion of shRNA cassettes was confirmed by restriction mapping and direct DNA sequencing. Recombinant lentiviruses were generated by co-transfecting human embryonic kidney 293T cells (HEK293T, ATCC) with the lentivirus expression plasmid and packaging plasmid. Briefly, $1.5 \times 10^7$ HEK293T cells were seeded in a 15-cm dish and cultured overnight in DMEM medium supplemented with 10% FBS, 2 mM L-glutamine, and 1% penicillin and streptomycin at 37° C. in a cell culture humidified incubator. Lentiviral expression plasmid (10 μg) and package plasmid (pMd2G, 3 μg; psPax2, 9 μg) were pre-mixed in 1 mL Opti-MEM (Gibco) and Lipofectamine 2000 (80 μL, Life Technologies). Following incubation at room temperature for 15 minutes, contents were then added dropwise to HEK293T cells and incubated for another 16 hours. The medium was then replenished with 25 mL of complete growth medium, and cells were incubated at 37° C. for another 48 hours. Next, the culture medium was collected in a syringe and filtered through a 0.45 μm polyethersulfone membrane filter to remove cell debris. Afterward, ⅓ volume of Lenti-X concentrator (Clontech) was added to the medium and incubated for 1 hour at 4° C. The viral supernatant was concentrated by centrifugation at 1,500 g for 45 minutes to obtain a pellet. The supernatant was removed carefully, and the pellet was resuspended in 250 μL of 1×DPBS without $Ca^{++}$ and $Mg^{++}$. The titer of the viral particles was estimated by the *Lenti*-XTM real-time quantitative polymerase chain reaction (RT-qPCR) Titration Kit (TaKaRa Bio) following the supplier's protocol and then aliquoted and stored at −80° C. until use.

Lentivirus Transduction

ACLp cells or C2C12 or C3H10T1/2 cells were seeded in monolayers at a density of $1 \times 10^5$ cells/well in a 12-well plate for 24 hours and then transduced with scrambled shRNA or KIF26B shRNA at a multiplicity of infection (MOI) of 20 using growth medium containing 100 μg/mL protamine sulfate (5 mg/mL protamine sulfate in Opti-MEM medium) for 24 hours. Fresh growth medium containing Puromycin (4 μg/mL, Sigma-Aldrich) was added for 48 hours to select resistant colonies that acquired successful transduction.

Osteogenic Differentiation Assay

The osteogenesis was induced by using an osteogenic induction medium StemPro Osteogenesis Differentiation Kit (Gibco) according to the manufacturer's instructions. This medium is composed of StemPro Osteocyte/Chondrocyte Differentiation Basal Medium and StemPro Osteogenesis Supplement and supplemented with 1% penicillin/streptomycin. In brief, ACLp cells transduced with KIF26B shRNA or scrambled shRNA ACLp were seeded at a density of $2 \times 10^5$ cells/well in 12-well plates either in growth medium or in osteogenic induction medium for up to 28 days with fresh medium changed every 3 days to maintain the activity of cells. For osteogenesis of C3H10T1/2 or C2C12 cells, mouse StemXVivo® Osteogenic/Adipogenic Base Media (R&D Systems) and Mouse/Rat StemXVivo® Osteogenic Supplement (R&D Systems) were used according to the manufacturer's protocol. In brief, cells transduced with Kif26b, or scrambled shRNA were seeded in a 12-well plate at a density of $2 \times 10^5$ cells/well with osteogenic differentiation medium for up to 21 days. Fresh medium was changed every other day. The cultured cells were collected at the indicated time points for staining or for RNA and protein extraction.

Assessment of Osteogenesis by Alizarin Red Staining

Alizarin red staining was performed to measure mineral deposition at indicated time points days after osteogenic induction (26). ACLp cells or C2C12 or C3H10T1/2 cells were washed twice with 1×PBS and fixed in 4% paraformaldehyde (PFA) solution in PBS for 15 minutes at room temperature. After washing 3 times with deionized $H_2O$, cells were stained with a 2% Alizarin Red S Staining Kit (pH 4.2, ScienCell™ Research Laboratories) for 30 minutes at room temperature. Then the dye was removed, and cells were washed with deionized $H_2O$ at least 3 times. Cells were visualized under a light microscope and images were captured using optical EVOS XL Core Imaging System (Thermo Fisher Scientific).

Chondrogenic Differentiation Assay

To induce chondrogenesis in 3D culture, the pellet culture method was employed. ACLp cells were transduced with scrambled or KIF26B shRNA at an MOI of 20 for 48 hours and then selected with puromycin (5 μg/mL). To prepare pellets, growth medium containing $3 \times 10^5$ cells was dispensed into a 15 mL conical polypropylene tube and spun at 200 g for 5 minutes. The growth medium was replaced by chondrogenic medium: high glucose DMEM (Gibco), 1% penicillin/streptomycin (Sigma-Aldrich), 1% insulin-transferrin-selenium Plus Premix (Corning), 100 nM dexamethasone (Sigma-Aldrich), 10 ng/mL TGF-β3 (R&D Systems), 50 μg/mL L-ascorbic acid 2-phosphate (Sigma-Aldrich), and 40 μg/mL L-proline (Sigma-Aldrich). The tubes with pellets were incubated at 37° C. under hypoxic conditions (2% O2) for up to 28 days with medium replenished every other day. The lids of the tubes were loosened to facilitate air exchange. For histology, the pellets were fixed in 10% neutral buffered formalin solution for 2 hours, followed by dehydration in serial dilutions of ethyl alcohol (30% to 50% to 70%) for 30 minutes each. Same procedures were repeated to obtain the pellets for total RNA extraction. Images were acquired from the pellets at the same scale using a standard ruler.

Assessment of Chondrogenesis by Safranin-O Staining

The pellets were embedded in paraffin wax and sections with a thickness of 5 μm were cut from the paraffin block and coated on the glass slide. The sections were deparaffinized with xylazine and ethyl alcohol and hydrated in distilled water. Sections were first stained with Weigert's iron hematoxylin working solution for 10 minutes. After washing in running tap water for 10 minutes, sections were stained with 0.1% aqueous fast green solution for 5 minutes. Sections were rinsed quickly with 1% acetic acid solution for no more than 15 seconds. Next, to visualize glycosaminoglycan, sections were stained with 0.1% aqueous Safranin-O solution for 5 minutes resulting in orange/red staining of negatively charged glycosaminoglycans. Finally, the sections were dehydrated and cleared with 95% ethyl alcohol, absolute ethyl alcohol, and xylene, using 2 changes each, 2 minutes each, cover slipped and imaged using NanoZoomer (Hamamatsu).

RNA Isolation and RT-qPCR

Total RNA was extracted from the cells or pellets using RNeasy Mini Kit (Qiagen), according to the manufacturer's instructions (18). The amount and quality of RNA were measured by a Nanodrop spectrophotometer (NanoDrop 2000). The isolated RNA samples were retrotranscribed with a High-Capacity cDNA Reverse Transcription Kit (Thermo Fisher Scientific) to synthesize the first strand of single-stranded cDNA (18). Briefly, a reaction containing 1 μg RNA, reaction buffer, dNTP, random primers, and transcriptase was incubated at 25° C. for 10 minutes, followed by 37° C. for 2 hours, and finally at 85° C. for 5 minutes. The cDNA was stored at −20° C. for future use. To determine the expression of target genes, RT-qPCR was performed using standard methods. 20 μL of reaction mix containing 10 μL of SYBR Green Real-Time PCR Master Mix (Thermo Fisher Scientific), 1 μL cDNA, and 200 nM of gene-specific forward/reverse primer sets. Sequences for the forward/reverse primers are shown in TABLE 2.

TABLE 2

The characteristics of primers used in this study.

| Gene symbol | Species | Accession No. | Forward Primer Sequence 5' to 3' |
|---|---|---|---|
| KIF26B | Homo sapiens | NM_018012.4 | CGTGTTCTTCACACTGCACA (SEQ ID NO: 5) |
| ALPL | Homo sapiens | NM_000478.5 | GACATCGCCTACCAGCTCAT (SEQ ID NO: 6) |
| RUNX2 | Homo sapiens | NM_001278478.1 | ACAGTAGATGGACCTCGGGA (SEQ ID NO: 7) |
| BGLAP | Homo sapiens | NM_199173.5 | GTAGTGAAGAGACCCAGGCG (SEQ ID NO: 8) |
| PCNA | Homo sapiens | NM_002592.2 | AACCTGCAGAGCATGGACTC (SEQ ID NO: 9) |
| XRCC2 | Homo sapiens | NM_005431.2 | CCTTGCCCGACTTGAAGGTA (SEQ ID NO: 10) |
| BAX | Homo sapiens | NM_001291428.2 | CTGACGGCAACTTCAACTGG (SEQ ID NO: 11) |
| BCL2 | Homo sapiens | NM_000633.2 | GGGAGGATTGTGGCCTTCTT (SEQ ID NO: 12) |
| WNT16 | Homo sapiens | NM_057168.1 | CTTTGGCTACGAGCTGAGCA (SEQ ID NO: 13) |
| AXIN2 | Homo sapiens | NM_004655.4 | TGATGCGCTGACGGATGATT (SEQ ID NO: 14) |
| SOX9 | Homo sapiens | NM_000346.4 | CGAGCCCGATCTGAAGAAGG (SEQ ID NO: 15) |
| COL2A1 | Homo sapiens | NM_001844.4 | CCCAGAGGTGACAAAGGAGA (SEQ ID NO: 16) |
| ACAN | Homo sapiens | NM_001135.4 | GGCACTAGTCAACCCTTTGG (SEQ ID NO: 17) |
| PPIA | Homo sapiens | NM_021130.4 | CTGCACTGCCAAGACTGAG (SEQ ID NO: 18) |
| Kif26b | Mus musculus | NM_001161665.1 | ctcaactcggtggccat-tca (SEQ ID NO: 19) |
| Runx2 | Mus musculus | NM_001146038.2 | ccacctctgacttctgcc tc (SEQ ID NO: 20) |
| Bglap2 | Mus musculus | NM_001032298.3 | gtccaagcag-gagggcaata (SEQ ID NO: 21) |
| Alpl | Mus musculus | NM_007431.3 | ctgactgacccttcgctctc (SEQ ID NO: 22) |
| Axin2 | Mus musculus | NM_015732.4 | gaccgacgattccatgt cca (SEQ ID NO: 23) |
| Gapdh | Mus musculus | NM_001289726.1 | aggtcggtgtgaacggatt tg (SEQ ID NO: 24) |

| Gene symbol | Location | Amplicon size (bp) | Reverse Primer Sequence 5' to 3' |
|---|---|---|---|
| KIF26B | 2480-2591 | 102 | TTTCACACAGCTGCCGAGAT (SEQ ID NO: 25) |
| ALPL | 871-993 | 123 | CCTGGCTTTCTCGTCACTCT (SEQ ID NO: 26) |
| RUNX2 | 868-974 | 107 | GGATGAGGAATGCGCCCTAA (SEQ ID NO: 27) |
| BGLAP | 403-524 | 122 | TCAGCCAACTCGTCACAGTC (SEQ ID NO: 28) |
| PCNA | 345-463 | 119 | ATACTGGTGAGGTTCACGCC (SEQ ID NO: 29) |
| XRCC2 | 104-221 | 118 | TCCTGTTCCTTCTGGGCCAT (SEQ ID NO: 30) |
| BAX | 356-480 | 125 | GTCCAATGTCCAGCCCATGA (SEQ ID NO: 31) |
| BCL2 | 926-1023 | 98 | ATCCACAGGGCGATGTTGTC (SEQ ID NO: 32) |
| WNT16 | 581-694 | 114 | TCTGTCATGTTGCCTGCACT (SEQ ID NO: 33) |
| AXIN2 | 1227-1347 | 121 | ATTGGCCTTCACACTGCGAT (SEQ ID NO: 34) |
| SOX9 | 540-630 | 91 | CCAGTCGTAGCCTTTGAGCA (SEQ ID NO: 35) |
| COL2A1 | 3521-3619 | 117 | CACCTTGGTCTCCAGAAGGA (SEQ ID NO: 36) |
| ACAN | 5704-5779 | 95 | CTGAACCCTGGTAACCCTGA (SEQ ID NO: 37) |
| PPIA | 430-546 | 117 | TGGTCTTGCCATTCCTGGAC (SEQ ID NO: 38) |
| Kif26b | 1348-1461 | 114 | ggtctctgtcatcagct ggg (SEQ ID NO: 39) |
| Runx2 | 1292-1386 | 95 | gaactgcctggggtctg aaa (SEQ ID NO: 40) |
| Bglap2 | 156-263 | 108 | ttaagctcacactgctc ccg (SEQ ID NO: 41) |
| Alpl | 1153-1255 | 103 | ggtcaatcctgcctcct tcc (SEQ ID NO: 42) |

TABLE 2-continued

The characteristics of primers used in this study.

| Axin2 | 1270-1381 | 112 | attggccttcacactgc gat(SEQ ID NO: 43) |
| Gapdh | 100-222 | 123 | tgtagaccatgtagttg aggtca(SEQ ID NO: 44) | bp = base pair

RT-qPCR was performed on a 7500 Fast Real-time PCR System (Applied Biosystems). The relative expression levels of target genes were normalized to the amount of PPIA expressed. The relative mRNA expression between groups was calculated using the 2-ΔΔCt method.

Western Blot Analysis

Total cell lysates for the protein analysis were prepared by radioimmunoprecipitation assay buffer (Abcam) containing 50 mM Tris-HCl (pH 8.0), 150 mM NaCl, 1% Triton-X-100, 0.1% SDS, 0.5% sodium deoxycholate, and supplemented with 1× complete protease inhibitor cocktail (Millipore Sigma). Total protein concentration was analyzed using Bradford Protein Assay (Bio-Rad). Protein was fractioned in a precast polyacrylamide gel and transferred to polyvinylidene fluoride or polyvinylidene difluoride membrane. Odyssey Blocking buffer (LI-COR Biosciences) containing 0.1% Tween 20 was used to block the protein-containing membranes for 1 hour at room temperature. The membranes were probed with a specific primary antibody diluted with Odyssey Blocking buffer overnight at 4° C. The following primary antibodies were used: anti-active β-catenin (8814; Cell Signaling Technology); anti-total-β-catenin (ab16051, Abcam), anti-KIF26B (17422-1-AP, Proteintech) at a 1:1000 dilution and β-actin (A2228; Sigma-Aldrich) at 1:4000 dilution. Secondary antibodies from LI-COR (IRDye® 800CW-labeled anti-rabbit; IRDye® 680RD-labeled anti-mouse) were applied at 1:20000 dilution for 50 minutes at room temperature. Membranes were scanned by LI-COR Odyssey Imager (LI-COR Biosciences) at medium resolution using LI-COR software (RRID: SCR_014579).

Detection of Cell Proliferation by CCK-8 Assay

The numbers of living ACLp cells were measured in a proliferation assay using a Cell Counting Kit 8 (CCK-8, Sigma-Aldrich) according to the supplier's protocol. Briefly, ACLp cells were plated in a 96-well plate at a density of $1 \times 10^3$ cells/well. After transduction with scrambled shRNA or KIF26B shRNA for 24 hours, the cells were cultured for indicated time points (0, 3, 5, and 7 days). In the CCK-8 assay, 100 μL of growth medium with 10 μL of CCK-8 solution was added to each well and the plate was incubated at 37° C. for 2 hours. Finally, the absorbance of each well was measured at 450 nm wavelength using BioTek Cytation 5 (BioTek Instruments).

5-Ethynyl-2'-Deoxyuridine (EdU) Incorporation Assay

The proliferation of ACLp was evaluated by using Click-iT™ EdU Imaging Kit (Invitrogen) according to the supplier's protocol. Briefly, cells were seeded in a 24-well plate at a density of $1 \times 10^4$ cells/well and transduced with scrambled shRNA or KIF26B shRNA. Following culture for 48 hours, cells were exposed to 10 μM EdU reagent for 2 hours then fixed with 4% PFA, permeabilized with 0.5% Triton X-100, and stained with Click-IT reaction cocktail. The cell nuclei were marked with Hoechst 33342 (Invitrogen) at a concentration of 5 μg/mL for 30 minutes. The ratio of EdU positive cells to total cells was calculated under a high magnification field using an Axio Observer Fluorescence microscope (Zeiss).

Terminal Deoxynucleotidyl Transferase-Mediated dUTP Nick End Labeling (TUNEL) Assay ACLp cells apoptosis was measured by TUNEL assay using In Situ Cell Death Detection Kit, Fluorescein (Roche) according to the manufacturer's protocol. Briefly, $5 \times 10^4$ cells were seeded in a 24-well culture plate and transduced with either KIF26B shRNA or scrambled shRNA for 3 days. Cells were then washed 3 times with 1×PBS and fixed with 4% PFA and permeabilized with 0.1% Triton X-100. The TUNEL reaction mixture was prepared with label solution and enzyme solution at a ratio of 1:9. The cells were incubated with the TUNEL reaction mixture at 37° C. for 1 hour, followed by Hoechst 33342 staining to identify the nuclei. The samples were visualized with an Axio Observer fluorescence microscope (Zeiss). The percentage of TUNEL-positive cells in 4 microscopic fields was calculated for quantification purposes using this formula: number of dead cells/total number of cells×100.

Treatment of ACLp Cells with Wnt Agonist

To demonstrate whether the Wnt/β-catenin pathway improves osteogenic differentiation of ACLp cells that was inhibited by KIF26B knockdown, ACLp cells were treated with the Wnt signaling agonist II SKL2001 (EMD Millipore), a small molecule activator of Wnt/β-catenin pathway (27). In short, $5 \times 10^5$ ACLp cells were first treated with KIF26B shRNA or scrambled shRNA for 48 hours and selected by Puromycin for another 48 hours. Afterward, $2 \times 10^5$ ACLp cells were seeded in a 12-well plate. Next osteogenesis was induced as above but in addition, SKL2001 (10 μM) dissolved in dimethyl sulfoxide (DMSO, Sigma-Aldrich) or DMSO only (vehicle) was added to cells. The medium was changed 3 times a week. After 7 days of osteogenic induction, the protein levels of active and total β-catenin were detected by Western blot as described above. After culture for 28 days, the Alizarin red staining was performed as above. After 28 days of osteogenic induction, RNA was isolated and expression of AXIN2 and WNT16 was measured using standard methods detailed above.

Murine Model of Intra-Articular Ectopic Calcification

B6-129SF2/J mice were purchased from The Jackson Laboratory (Stock No. 101045/J). Mice were kept at the institution's animal facility with a constant humidity of 30-70%, temperature of 21±1° C., light/dark cycle of 12 hours, and high standards of animal husbandry. Experiments were performed on 10-week-old male mice under general anesthesia (2.5% isoflurane in 4 L/minute oxygen). Animals received an intra-articular injection 24 hours before loading and then once fortnightly for up to 8 weeks using a previously described method (28). Mice either received 10 μL lentivirus Kif26b shRNA (treatment group, n=8) or the same volume of lentivirus scrambled shRNA (control group, n=7). Ectopic calcification was instigated in the knee using a non-invasive ACL rupture model (2,29). Briefly, axial compression was applied through the foot joint via the upper loading cup of a material testing machine (Instron ElectroPuls E1000), while the lower cup held the knee in a fixed position and connected to the load cell. The cyclic load was applied for 0.34 seconds, with a rise and fall time each of 0.17 seconds and a baseline hold time of 10 seconds between each cycle. The highest loading force used was 12 Newtons with a 0.5 Newtons preload force to maintain the limb in a fixed position between periods of peak loading. This loading pattern was repeated 60 times in a single loading session. The contralateral left limb served as a control. After recovery from anesthesia, mice resumed prior cage activity with ad libitum food and water intake. At 8 weeks post-injury, mice were sacrificed in a carbon dioxide chamber. Knee joints were separated from the body and skin and soft tissues were removed. Joints were fixed in 10% neutral buffered saline for 48 h. Following washing with 1×PBS, samples were infiltrated in 30% sucrose and kept at 4° C. for a week for micro-computed tomography (μCT) scanning.

μCT Analysis

Two mice in each group were scanned by in vivo μCT using a vivaCT-40 μCT scanner (Scanco-Medical) 4 weeks after loading to examine the development of ectopic calcification. Increased mortality was noted following in vivo μCT imaging, therefore, analysis of ectopic nodules was restricted to ex vivo imaging only and examples of in vivo imaging were used as illustrative information. Ex vivo μCT of all mice was used to detect ectopic calcification in mouse knee at 8 weeks after loading. Ossified nodules were visualized by constructing 3-dimensional images in Dragonfly imaging software (Object Research Systems), and were quantified by calculating all mineralized areas in and around the joint space excluding the patella, anterior horns of the menisci, and fabella. All analyses were carried out in a blinded fashion. To determine any off-target effects of Kif26b knockdown on pre-existing bone, a number of trabecular and subchondral bone parameters were measured. The following μCT settings were used as described previously (2): energy=45 kV, voxel size=21 μm, intensity=177 μA and integration time=300 ms. The following morphometric parameters of the tibial cancellous bone were calculated for trabecular epiphyseal compartments: trabecular bone volume fraction (BV/TV), trabecular thickness (Tb.Th), trabecular separation (Tb.Sp), volumetric bone mineral density (vBMD) and tissue mineral density (TMD). Subchondral bone thickness was measured using a custom-written MATLAB 2015b program (MathWorks).

Histology and Confocal Microscopy

Undecalcified hind limbs were fresh frozen and sectioned at 5 μm thickness using a cryostat, and stained with Safranin-O as described above. The sections were imaged using a NanoZoomer digital slide scanner (Hamamatsu). To confirm the knockdown of Kif26b in vivo, immunofluorescent staining was performed. For immunofluorescence, sections were washed with 1×PBS three times. Antigen retrieval was accomplished with 10 μg/mL proteinase K (EMD Millipore) in 10 mM Tris-HCl (pH 7.4-8.0) for 20 minutes at 37° C. Non-specific binding was then blocked with 10% goat serum for 1 hour at room temperature. Slides were incubated with rabbit anti-Kif26b (1:50, 17422-1-AP, Proteintech) and rat anti-type II collagen (in-house, 1:200) in 2% goat serum overnight at 4° C. in a humidified chamber. Antigens were detected by Alexa Fluor® 488 conjugated goat anti-rabbit polyclonal antibody (1:200, ab150077, Abcam) and Alexa Fluor® 594 conjugated goat anti-rabbit polyclonal antibody (1:200, ab150080, Abcam) for 1 hour at room temperature. After another wash, slides were counterstained with Fluoro-Gel II with DAPI. Images were taken with Confocal Laser Scanning Microscope (Leica).

Statistical Analyses

Each experiment was performed at least three times in independent patient samples and each assay included a minimum of three technical replicates. Images are shown from representative experiments and numeric data are expressed as mean±standard deviation from all experiments to display the variability across different experiments. Descriptive statistics were used to report group means and standard deviations for numerical data reported in the text. Quantitative data are shown in the form of box plots with minimum and maximum values and each individual data point unless displayed otherwise. Data were analyzed with the use of GraphPad PRISM ver. 9 (GraphPad Software). A two-tailed Unpaired t-test or Mann-Whitney test was used for comparison between the two groups. Kruskal-Wallis test with Dunn's multiple comparison test was used for comparison between more than two groups. For normally distributed data, a 1-way analysis of variance with Tukey's post hoc test was used. Two-way analysis of variance test was used for human cell proliferation assay, some chondrogenic expression data, and for mouse trabecular and subchondral bone parameters using Šídák's multiple comparison test when the interaction was significant. The criterion of statistical significance was set at a $p<0.05$ for all analyses.

Results

Figure 2F:
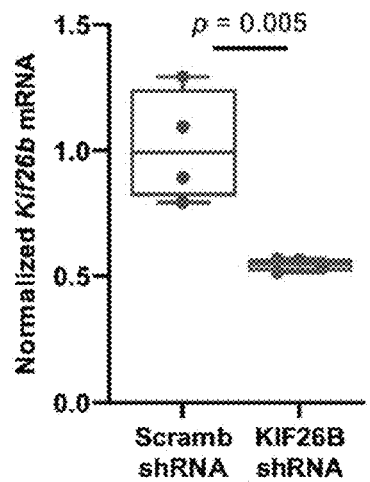
Figure 2G:
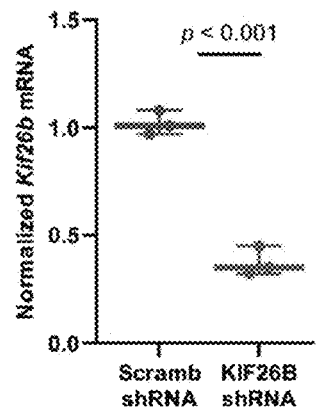

Lentivirus-shRNA successfully knocks down KIF26B mRNA and protein KIF26B expression in human ACLp cells and murine C3H10T1/2 and C2C12 cells was ablated via lentivirus-mediated shRNA targeting KIF26B (see e.g., FIG. 2A-FIG. 2B). KIF26B mRNA expression as measured by RT-qPCR was effectively inhibited to about 80% after KIF26B shRNA transduction compared to scrambled shRNA transduction (0.21±0.03 vs. 1.01±0.14; $p<0.001$) (see e.g., FIG. 2C). The data from RT-qPCR paralleled Western blot findings. KIF26B protein production as detected by Western blot analysis was also decreased significantly by KIF26B shRNA compared to scrambled shRNA (0.24±0.10 vs. 1.00±0.00; $p<0.001$) (see e.g., FIG. 2D-FIG. 2E). Similar to human ACLp cells, the expression of Kif26b was also knocked down in murine C3H10T1/2 and C2C12 cells. RT-qPCR analysis showed decreased Kif26b mRNA in C3H10T1/2 cells transduced with Kif26b shRNA compared to those transduced with scrambled shRNA (0.55±0.03 vs. 1.02±0.22; $p=0.005$) (see e.g., FIG. 2F). In C2C12 cells, the expression of Kif26b mRNA was lower in cells transduced with Kif26b shRNA than cells transduced with scrambled shRNA (0.37±0.07 vs. 1.02±0.06; $p<0.001$) (see e.g., FIG. 2G). These observations indicate that KIF26B shRNA transduction successfully suppressed the expression of KIF26B both at mRNA and protein levels in vitro.

ACLp Cells Express Stromal Cell Markers and Undergo Osteoblastic Differentiation In Vitro The cells that migrate out of human ACL tissues constitute a rich population of progenitor cells that exhibit stromal cell-like properties and have the ability to transdifferentiate into chondrocytes, osteoblasts, and fat cells (19). Cells began to migrate out of the tissues within a few days, and over a period of 3 weeks the culture plates became confluent (see e.g., FIG. 12A). Prior to testing the effect of KIF26B knockdown on ACLp cells transdifferentiation, these cells were tested for stromal cell markers and osteogenic differentiation potential. Immunostaining revealed that ACLp cells showed positive staining for CD44, CD90, CD146, and Stro-1, but negative for CD14 and CD19 (see e.g., FIG. 12B). Next, ACLp cells differentiated into osteoblasts when induced by osteogenic medium over a period of 28 days (see e.g., FIG. 12C). ACLp cells after osteogenic induction also displayed a significant increase in the osteogenic marker, ALPL compared with the cells in growth medium (13.04±6.33 vs. 1.08±0.52; $p=0.001$) (see e.g., FIG. 12D).

KIF26B Knockdown Attenuates Osteogenesis

To determine whether KIF26B knockdown significantly decreases osteogenic differentiation of ACLp cells, ACLp cells were transduced with KIF26B shRNA or scrambled shRNA in osteogenic medium for 28 days. Culture with osteogenic induction media significantly increased osteogenesis in control and scrambled shRNA groups compared with ACLp cells cultured in growth medium (data not shown). KIF26B knockdown significantly arrested osseous transdifferentiation of ACLp cells compared to scrambled shRNA (see e.g., FIG. 3A). To further confirm these findings, the expression of typical osteogenic markers was measured, showing that the expression of RUNX2 ($0.42\pm0.01$ vs. $1.00\pm0.01$; $p<0.001$), ALPL ($0.68\pm0.02$ vs. $1.06\pm0.06$; $p<0.001$), and BGLAP ($0.56\pm0.04$ vs. $0.88\pm0.11$; $p<0.001$) was decreased in ACLp cells receiving KIF26B shRNA compared with those receiving scrambled shRNA (see e.g., FIG. 3B-FIG. 3D). These findings suggests that KIF26B is required for osteogenic transdifferentiation of ACLp cells since its ablation significantly arrests this process.

Figure 4A:
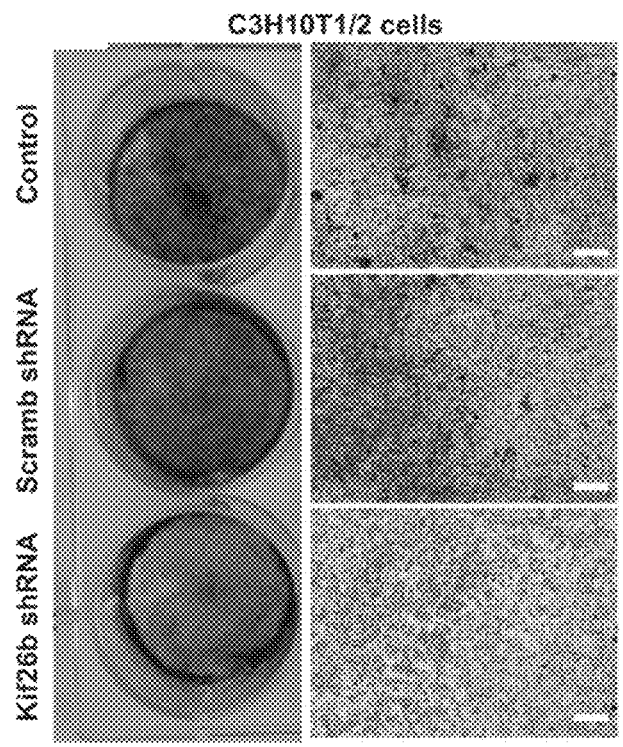
FIG. 4A-FIG. 4F. KIF26B silencing attenuates osteogenesis in C3H10T1/2 and C2C12 cells. A-B. Kif26b knockdown significantly arrested matrix mineralization of C3H10T1/2 cells (n=3) (A) and C2C12 cells (n=3) (B) compared to scrambled shRNA as shown by macro and microphotographs of Alizarin red-stained cells (scale bar=200 μm). C-F. mRNA expression of typical osteogenic marker genes namely Runx2 (C), Alpl(D), and Bglap (E) as well as AXIN2 (F) was significantly decreased in C2C12 cells (n=3) transduced with KIF26B shRNA compared with those transduced with scrambled shRNA (Mann-Whitney test).
Figure 4B:
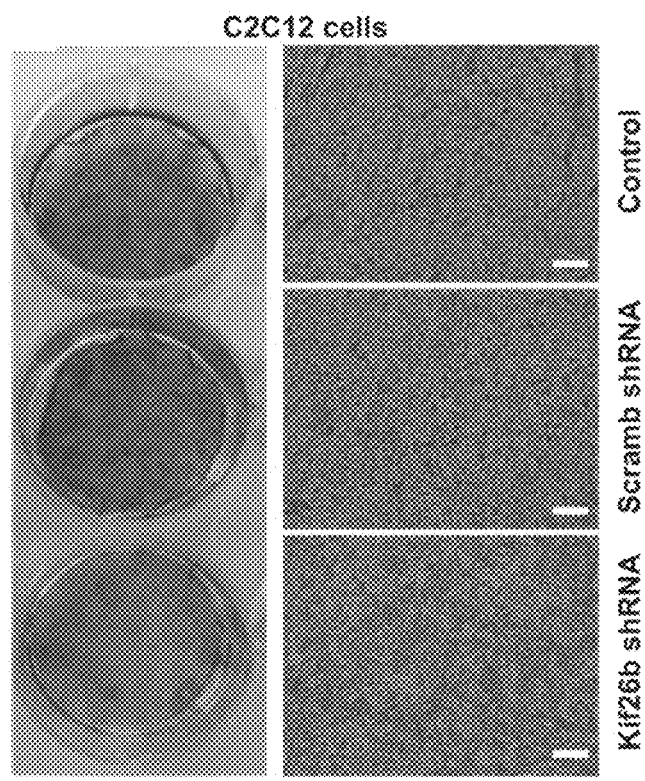
Figure 4C:
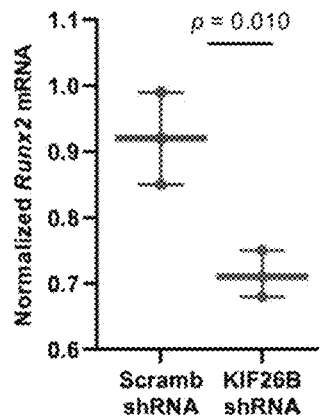
Figure 4D:
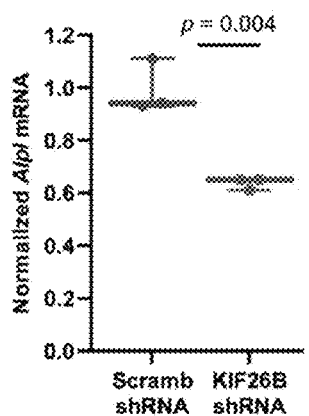
Figure 4E:
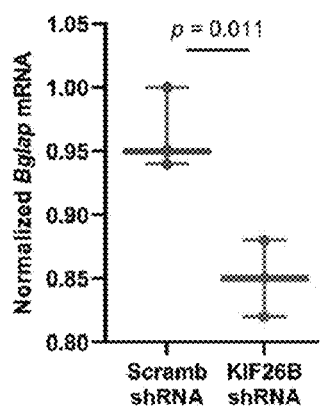
Figure 4F:
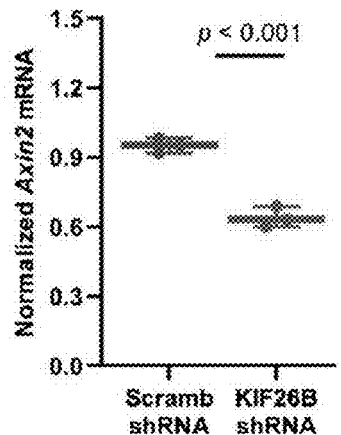
Figure 5A:
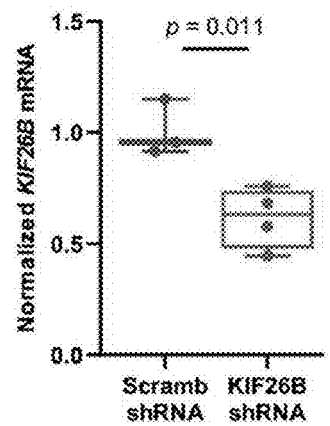
FIG. 5A-FIG. 5G. KIF26B knockdown resulted in enhanced chondrogenesis in ACLp cells. A. KIF26B mRNA expression was significantly decreased in pellets prepared from ACLp cells (n=3-4) transduced with KIF26B shRNA compared with scrambled shRNA (Mann-Whitney B-D. mRNA expression of typical chondrogenic marker genes namely SOX9 (B), COL2A1 (C), and ACAN (D) was significantly increased in pellets (n=3-4) with cells transduced with KIF26B shRNA than scrambled shRNA in both growth medium and chondrogenic medium. mRNA levels of SOX9, COL2A1, and ACAN in pellets were both significantly increased in chondrogenic medium compared to those in growth medium, regardless of whether cells were transduced with KIF26B shRNA or scrambled shRNA (2-way ANOVA with Šídák's multiple comparison test). E. mRNA expression of AXIN2 was significantly increased in pellet cultures (n=3-4) transduced with KIF26B shRNA compared with those transduced with scrambled shRNA (Mann-Whitney test). F. Size of the pellets was bigger in cells transduced with KIF26B shRNA than scrambled shRNA (n=3 each) (scale bar=1 cm). G. Safranin-O staining of histological sections of pellets showed more intense staining in the KIF26B shRNA group than scrambled shRNA group (n=3 each).
Figure 5B:
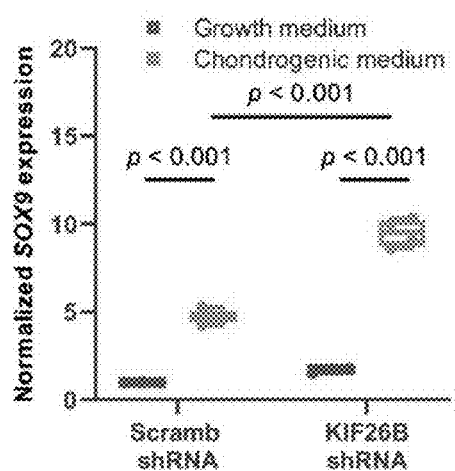
Figure 5C:
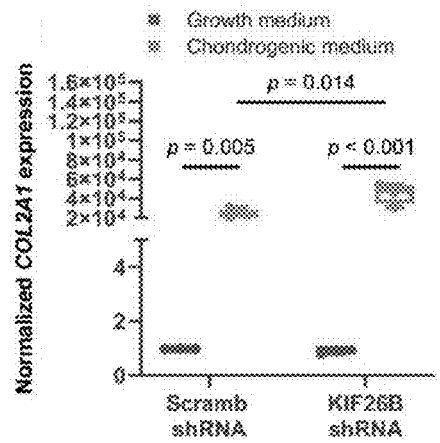
Figure 5D:
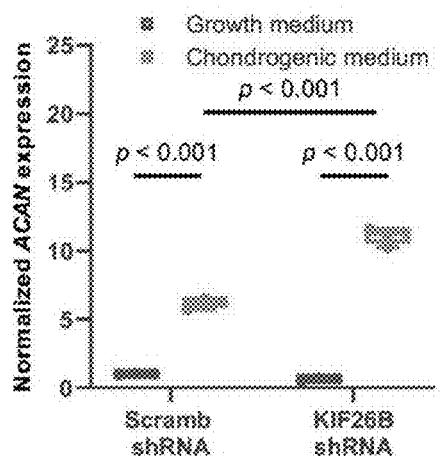
Figure 5E:
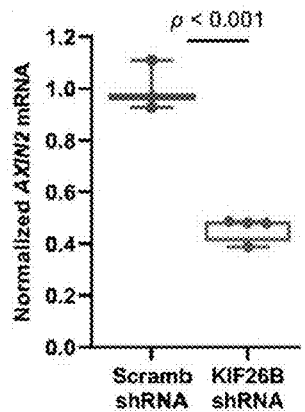
Figure 5F:
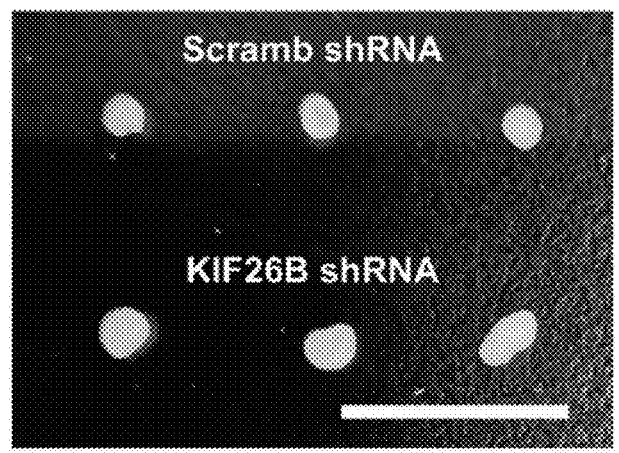
Figure 5G:
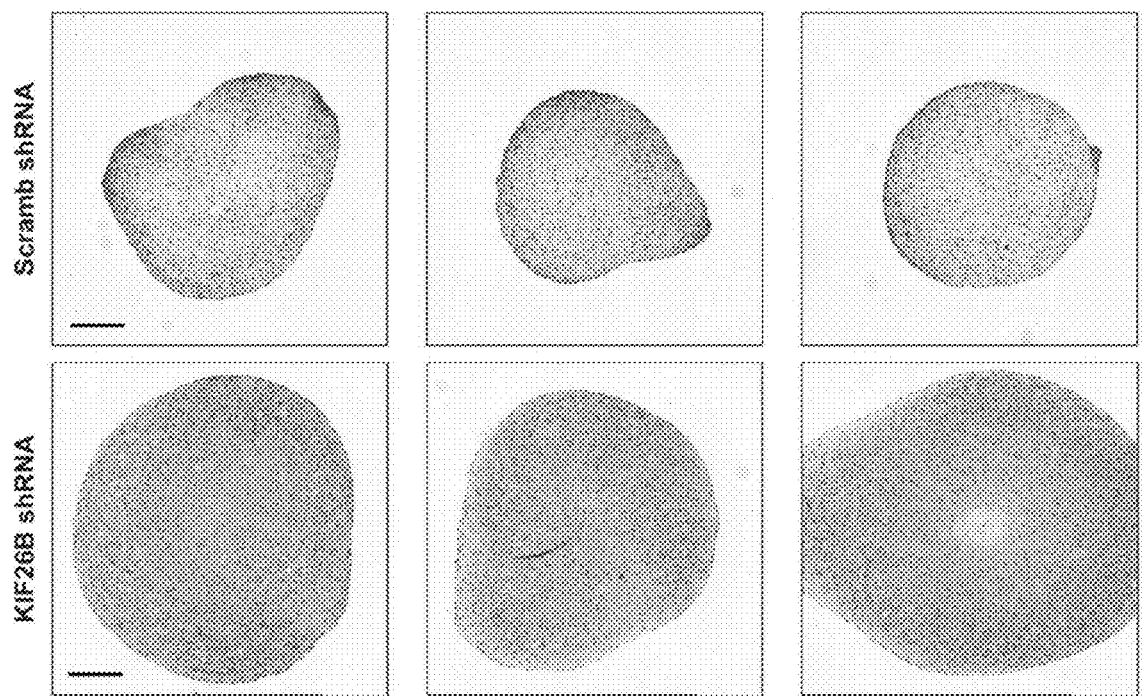

The functional role of Kif26b was also tested in two murine cell types: C3H10T1/2 cells and C2C12 cells. Kif26b knockdown significantly suppressed osteogenesis of C3H10T1/2 cells compared to scrambled shRNA (see e.g., FIG. 4A). Likewise, knockdown of Kif26b significantly arrested osseous transdifferentiation of C2C12 cells as evidenced by loss of Alizarin red staining (see e.g., FIG. 4B). This observation was further supported by decreased expression of osteogenic-specific marker genes Runx2 ($0.71\pm0.04$ vs. $0.92\pm0.07$; $p=0.010$) (see e.g., FIG. 4C), Alpl ($0.64\pm0.02$ vs. $0.99\pm0.10$; $p=0.004$) (see e.g., FIG. 4D), Bglap ($0.85\pm0.03$ vs. $0.96\pm0.03$; $p=0.011$) (see e.g., FIG. 4E), as well as the expression of Axin2 ($0.64\pm0.04$ vs. $0.95\pm0.03$; $p<0.001$) (see e.g., FIG. 4F), a downstream target of Wnt/β-catenin signaling.

KIF26B Loss-of-Function Promotes Chondrogenesis

To determine whether KIF26B knockdown affects the chondrogenic differentiation of ACLp cells, ACLp cells were transduced with KIF26B shRNA or scrambled shRNA in chondrogenic medium for 28 days. The expression of KIF26B mRNA was still significantly less in pellets prepared from cells transduced with KIF26B shRNA (n=4) than scrambled shRNA (n=3) ($0.62\pm0.13$ vs. $1.01\pm0.13$; $p=0.011$) after 28 days of chondrogenesis, indicating that KIF26B expression was successfully suppressed during the chondrogenesis (see e.g., FIG. 5A). The expression of typical chondrogenic-specific marker genes was then measured, showing a significant treatment (KIF26B shRNA, scrambled shRNA) by condition (growth medium, chondrogenic medium) interaction for SOX9 ($P<0.001$) (see e.g., FIG. 5B), COL2A1 ($p=0.018$) (see e.g., FIG. 5C), and ACAN ($p<0.001$) (see e.g., FIG. 5D), with increased expression of these markers in ACLp cells transduced with KIF26B shRNA compared with those transduced with scrambled shRNA. The expression of AXIN2 ($0.46\pm0.05$ vs. $1.00\pm0.96$; $p<0.001$) was decreased in cells transduced with KIF26B shRNA than scrambled shRNA (see e.g., FIG. 5E). The pellet size was slightly smaller in KIF26B shRNA group than scrambled shRNA group (see e.g., FIG. 5F). Cartilage matrix deposition was measured by histological examination of glycosaminoglycan by Safranin-O staining. The intensity of Safranin-O staining was very high (indicative of rich proteoglycan contents) in pellets in the KIF26B shRNA group in contrast to the scrambled shRNA group where the intensity was notably low (see e.g., FIG. 5G). More homogeneous chondrocytes, as demonstrated by Safranin-O staining, were observed in the KIF26B shRNA group than in the scrambled shRNA group. Together, these findings highlight a positive role of KIF26B knockdown on chondrogenic transdifferentiation of ACLp cells.

Loss of KIF26B Attenuates Cell Proliferation

To elucidate the effects of KIF26B knockdown on cell proliferation, the number of living ACLp cells was examined in the KIF26B shRNA group. Using CCK-8 assay, cells treated with KIF26B shRNA were shown to exhibit significantly fewer numbers at day 3, day 5, and day 7 time points compared to both cells treated with scrambled shRNA and non-treated control cells (see e.g., FIG. 6A). At day 1, no significant differences were observed in cell number across groups. At day 3, cell number was significantly lower in the KIF26B shRNA group compared to both control ($p=0.007$) and scrambled shRNA ($p=0.033$) groups. Similarly, at day 5 and 7, cell number was significantly lower in KIF26B shRNA transduced cells compared to untreated control ($p<0.001$; $p<0.001$) and cells transduced with scrambled shRNA ($p=0.002$; $p=0.001$).

EdU staining was then performed to gauge the effects of KIF26B knockdown on cell proliferation. Results showed that the number of EdU positive cells was less in the KIF26B shRNA transduced group than in the scrambled shRNA and control groups (see e.g., FIG. 6B). The number of EdU positive cells was also significantly different across groups (1-way ANOVA $p=0.012$, $F=10.27$). Specifically, there were significantly lower EdU positive cells in the KIF26B shRNA ($8.00\pm2.65$) group compared to the control ($19.33\pm4.93$; $p=0.047$) and scrambled shRNA ($24.00\pm5.29$; $p=0.011$) groups (see e.g., FIG. 6C). Finally, mRNA expression of various cell proliferation markers such as PCNA (Kruskal-Wallis $p<0.001$) and XRCC2 (Kruskal-Wallis $p<0.001$) was significantly lower in cells treated with KIF26B shRNA as shown in FIG. 6D. Specifically, the expression of PCNA was significantly lower in the KIF26B shRNA ($0.67\pm0.15$) group compared to control ($1.00\pm0.00$; $p=0.010$) and scrambled shRNA ($0.96\pm0.10$; $p=0.014$) groups. Similarly, the expression of XRCC2 was significantly lower in the KIF26B shRNA ($0.63\pm0.08$) group compared to control ($1.00\pm0.00$; $p=0.003$) and scrambled shRNA ($1.02\pm0.08$; $p=0.025$) groups.

Loss of KIF26B Induces Cellular Apoptosis

Recognizing that KIF26B loss-of-function attenuates cell proliferation, the KIF26B knockdown effect on cellular apoptosis was tested. Cells treated with KIF26B shRNA showed an increased number of TUNEL positive cells (see e.g., FIG. 7A). Quantification further showed that the fraction of TUNEL positive cells was significantly higher in the KIF26B shRNA group compared to the scrambled shRNA group ($4.65\pm0.62$ vs. $0.79\pm0.32$; $p<0.001$) (see e.g., FIG. 7B). In addition, the expression of genes related to cellular apoptosis was also measured. The expression of pro-apoptotic BAX mRNA was significantly increased in cells treated with KIF26B shRNA compared with cells treated with scrambled shRNA ($3.31\pm0.35$ vs. $0.97\pm0.08$; $p<0.001$) (see e.g., FIG. 7C). At the same time, the expression of the anti-apoptotic gene, BCL2, was significantly decreased in cells treated with KIF26B shRNA compared with scrambled shRNA ($0.46\pm0.01$ vs. $1.02\pm0.05$; $p<0.001$) (see e.g., FIG. 7D). The net ratio of BAX and BCL2 (BAX/BCL2), which is an indicator of apoptosis, was significantly increased in cells treated with KIF26B shRNA compared to those treated with scrambled shRNA ($7.29\pm0.80$ vs. $0.95\pm0.08$; $p<0.001$) (see e.g., FIG. 7E).

KIF26B Modulates Wnt/β-Catenin Signaling

Whether KIF26B knockdown influences canonical Wnt/β-catenin signaling was tested next. knockdown of KIF26B suppressed the expression of Wnt/β-catenin pathway as demonstrated by the decrease in mRNA expression of WNT16 ($0.70\pm0.02$ vs. $1.00\pm0.11$; $p<0.001$) (see e.g., FIG.

8A) and AXIN2 (0.97±0.03 vs. 0.63±0.04; p<0.001) (see e.g., FIG. 8B), mRNA compared to scrambled shRNA. These findings are supported by a decrease in the protein level of active β-catenin (0.47±0.13 vs. 1.00±0.00; p<0.001) and total β-catenin (0.55±0.21 vs. 1.00±0.00; p=0.005) in KIF26B shRNA cells compared to scrambled shRNA transduced cells (see e.g., FIG. 8C-FIG. 8E). Together, these data suggest that KIF26B modulates the expression of canonical Wnt/β-catenin signaling.

Next, Wnt agonist II, SKL2001, was used to test whether it rescues the lost phenotype. Compared with vehicle (DMSO), the expression of Wnt/β-catenin signaling genes, namely WNT16 (3.06±0.13 vs. 1.00±0.14; p<0.001) (see e.g., FIG. 9A) and AXIN2 (2.20±0.08 vs. 1.00±0.02; p<0.001) (see e.g., FIG. 9B), was increased in SKL2001 treated cells. These findings further demonstrate that decrease in osteogenesis due to KIF26B loss-of-function was reverted by the addition of Wnt agonist II (see e.g., FIG. 9C). Consistently, the protein levels of active β-catenin were decreased after KIF26B knockdown, which was significantly attenuated by SKL2001 treatment (see e.g., FIG. 9D). Quantification of Western blot signal intensity was in parallel to these observations both for active β-catenin (1-way ANOVA p<0.001, F=20.75) (see e.g., FIG. 9E) and total β-catenin (1-way ANOVA p<0.001, F=53.18) (see e.g., FIG. 9F).

Based on these observations, the working model displayed in FIG. 10 shows that KIF26B inhibition decreases total β-catenin and active β-catenin levels and results in suppression of osteogenesis of ACLp cells coupled with the inhibition of typical osteogenic-specific marker genes. Moreover, KIF26B silencing promotes the chondrogenic differentiation of ACLp cells and stimulates the expression of chondrogenic-specific markers.

Kif26b shRNA Treatment Suppresses Kif26b Expression and Mitigates Ectopic Calcification in Mice Whereas increased Kif26b staining was noted in knees treated with scrambled shRNA, the staining intensity of Kif26b in the Kif26b shRNA treatment group was minimal indicating that Kif26b shRNA administration effectively suppressed the expression of Kif26b protein in vivo (see e.g., FIG. 11A). Since KIF26B knockdown promoted chondrogenesis in vitro, proteoglycan was measured in ectopic calcified nodules. There was an increased Safranin O staining intensity in the Kif26b shRNA group compared with the scrambled shRNA group indicating increased chondrogenesis (see e.g., FIG. 11A). In order to investigate the role of Kif26b in ectopic calcification, an injury-induced ectopic calcification model was applied in mice. Intra-articular delivery of Kif26b shRNA did not reduce the number of calcified nodules at 4 weeks after injury as determined by in vivo μCT analysis (see e.g., FIG. 13). However, at 8 weeks, fewer nodules were observed in Kif26b knockdown group (see e.g., FIG. 11B). Quantification of nodules showed that the number of nodules significantly decreased in mice receiving Kif26b shRNA compared with scrambled shRNA (4.00±0.71 vs. 7.25±0.96; p<0.001) (see e.g., FIG. 11C).

Kif26b shRNA does not Affect Pre-Existing Trabecular and Subchondral Bone

The effect of Kif26b knockdown on already formed bone cancellous bone was measured in the proximal tibia. Kif26b knockdown did not significantly affect trabecular bone parameters namely BV/TV (p=0.883), Tb.Th (p=0.167), Tb.Sp (p=0.795), vBMD (p=0.855), and TMD (p=0.836), nor did it affect subchondral bone plate thickness (p=0.645) (see e.g., FIG. 14A-FIG. 14F).

DISCUSSION

These findings establish KIF26B as a critical participant in the osteogenic process and a viable pharmacotherapy target for the treatment of pathologic ectopic calcification. These results suggest that KIF26B plays a role in ectopic calcification which is a target for biologic treatments to treat and potentially prevent the development of ectopic calcification. These findings are clinically significant as there are currently no biological treatment options available to prevent or treat the development of ectopic calcification. Although surgical excision of ossified nodules from the joint is indicated in severe cases where calcified nodules impede joint movement (30), the recurrence rate is very high (31). Unlike osteophytes, which are attached to the bone surface, ectopic calcified nodules are embedded in the joint capsule and/or in the synovium. In addition, while these nodules are relatively benign when embedded in soft issues (e.g., synovium or joint capsule), they can become loose in the joint and put patients at risk for mechanical symptoms and damage to the articular cartilage. KIF26B was identified from a previous large-scale genetic screening of several advanced intercross mouse lines for the development of trauma-induced ectopic calcification, in which Kif26b was identified as a prime candidate gene implicated in ectopic calcification (4). A recent genome-wide association study in human cases of hip ossification identified KIF26B as a severity locus for pathological bone formation (14), independently verifying this finding in mice. These studies establish KIF26B on the leading edge of research into intra-articular ectopic calcification.

A recent study (14) showed that KIF26B is expressed in bone and that modulation of KIF26B in an in vitro model of murine myoblast osteogenesis is able to inhibit osseous transdifferentiation of C2C12 cells. This effect is mechanistically driven through ERK1/2 signaling. A novel finding of this study is that KIF26B affects the canonical Wnt/β-catenin signaling pathway. Previously, it has been reported that KIF26B functions via non-canonical Wnt5a-Ror signaling to control morphogenetic cell and tissue behavior (16). Kif26b has also been shown to switch the canonical β-catenin-dependent pathway toward the non-canonical PCP pathway (32). After Wnt3a stimulation, Kif26b depletion induces an increase in the ratio between active and total β-catenin, which suggests activation of the canonical Wnt signaling pathway. Cartilage repair has been demonstrated to require a switch in the Wnt pathway mediated by Wnt16 (33); this redirects the cell from the canonical pathway to the non-canonical pathway, where a repair pathway characterized by lubricin is synthesized in place of the canonical AXIN2. Although cartilage and bone do not appear on any tissue blots, one study showing enhancer-trap LacZ transgene of Kif26b during development demonstrated strong expression in the somites, limb buds, and face in the embryo (34). In addition, studies of stem cell differentiation showed increases in Kif26b as cells differentiate into chondrocytes (17).

KIF26B also modulated two particularly important cellular processes: cell proliferation and apoptosis. Cells treated with KIF26B shRNA showed impaired viability and proliferation capability compared to control cells. As cell proliferation is associated with increased ossification (35), the observation that KIF26B knockdown suppresses cell proliferation and ectopic calcification explains the role of KIF26B in modulating ectopic calcification by altering cell function. The osteogenic medium would significantly promote the proliferation of ACLp cells transduced with KIF26B shRNA, which is different from the effects of KIF26B knockdown on ACLp cells in the context of growth medium. Compared to growth medium, the ingredients in osteogenic medium facilitate cell proliferation and then induce osteogenic differentiation. That may be the reason that massive cell apoptosis was not observed after KIF26B silencing in ACLp cells during osteogenesis. While there is no direct link known between ectopic calcification and apoptosis, some studies have shown that factors that induce heterotopic ossification such as hypoxia and HIF1α (7) regulate apoptosis (35,36).

In this study, ligament-derived progenitor cells were used in contrast to more commonly used mesenchymal progenitor cells, although it was confirmed that KIF26B loss-of-function equally impedes osteogenesis in other cell types such as murine C2C12 and C3H10T1/2 cells. Since ACLp cells express stem cell markers as defined by the International Society of Cellular Therapy and adhere to plastic (37), these cells have translational value for this clinical problem. This approach offers some advantages from clinical and translational perspectives. While heterotopic ossification in tendons and ligaments is not uncommon (38), frequently occurring in inflamed and injured ligaments/tendons which results in disability and pain, its pathogenesis is poorly understood. Calcification in tendons and ligaments follows the same endochondral ossification path that is followed by embryonic bone development and ossification of the knee (39,40). However, this study does not imply that ACLp cells are the sole source of cells that contribute to ectopic calcification in the joint. Several other cell types have been implicated in ectopic bone formation such as immune and stromal cells and CD146+ pericytes (41,42). It has previously been shown that cells responding to ACL tears in mice originate from the synovium, subchondral bone marrow, and Groove of Ranvier (29). Intra-articular injection of KIF26B shRNA targets all cells within the synovial joint so the therapeutic effect observed in this study is not specific to ACLp cells.

While this study demonstrates that Kif26b knockdown suppresses the development of intra-articular ectopic calcification after mechanical trauma and provides some mechanistic insights, many questions remain. For instance, shown herein is that the Wnt/β-catenin pathway is involved downstream of KIF26B, whereas other studies (14) have shown crosstalk between ERK signaling and KIF26B. A number of other studies have shown the involvement of other critical genes and pathways in heterotopic ossification, such as HIF-1α (7), TGF-β (40), and BMP-2 (43). Further research may investigate whether these pathways are linked to KIF26B signaling. Thus, it is clear while several genes and pathways participate in this phenotype, ectopic calcification occurs mainly through endochondral bone formation. To this end, the role of KIF26B on chondrogenic differentiation of ACLp cells was examined, finding that knockdown of KIF26B instead increased chondrogenesis. It was an interesting observation as it implies that the decrease in ectopic calcification was predominantly through inhibition of the osteogenic pathway. This observation also highlights that KIF26B has a dual but opposite effect on endochondral ossification.

While the function of KIF26B on chondrogenesis has not been reported previously, many studies have demonstrated that loss of Wnt signaling exacerbates chondrogenesis (44, 45), much of this can be explained by decreased Wnt signaling with KIF26B knockdown in these experiments. Intense Safranin O staining of nodules in Kif26b shRNA treated knees corroborated findings that KIF26B knockdown increases chondrogenic differentiation of ACLp cells. Additional detailed time-course studies using other techniques such as in vivo cell labeling and histology may be used to assess when KIF26B affects chondrogenesis and osteogenesis. The role of cellular processes such as proliferation and apoptosis in the development of ectopic calcification is still yet to be determined. Studies with KIF26B genetic gain/loss-of-function studies in murine ectopic calcification would be another opportunity to better understand the role of KIF26B in ectopic calcification.

In summary, this study explored the effects of KIF26B silencing on inhibition of ectopic calcification development in vitro and in vivo and identified crosstalk between KIF26B and canonical Wnt/β-catenin signaling during osteogenic differentiation. These findings demonstrate that inhibition of KIF26B is a potential target for interventions to treat pathological bone formation such as ectopic calcification and heterotopic ossification. This study also provides new insights into understanding the mechanism of ectopic calcification, although additional studies are desirable to fully capture the etiopathogenesis of this pathology.

REFERENCES

1. Scott M A, Levi B, Askarinam A, Nguyen A, Rackohn T, Ting K, et al. Brief review of models of ectopic bone formation. Stem Cells Dev. Mar. 20, 2012;21(5):655-67.
2. Rai M F, Duan X, Quirk J D, Holguin N, Schmidt E J, Chinzei N, et al. Post-Traumatic Osteoarthritis in Mice Following Mechanical Injury to the Synovial Joint. Sci Rep. Mar. 27, 2017;7:45223. Epub 2017/03/28.
3. Forsberg J A, Pepek J M, Wagner S, Wilson K, Flint J, Andersen R C, et al. Heterotopic ossification in high-energy wartime extremity injuries: prevalence and risk factors. J Bone Joint Surg Am. May 2009; 91(5):1084-91. Epub 2009/05/05.
4. Rai M F, Schmidt E J, Hashimoto S, Cheverud J M, Sandell L J. Genetic loci that regulate ectopic calcification in response to knee trauma in LG/J by SM/J advanced intercross mice. J Orthop Res. October 2015; 33(10): 1412-23. Epub 2015/05/20.
5. Pacifici M. Acquired and congenital forms of heterotopic ossification: new pathogenic insights and therapeutic opportunities. Curr Opin Pharmacol. June 2018; 40:51-8. Epub 2018/04/04.
6. Sinha S, Uchibe K, Usami Y, Pacifici M, Iwamoto M. Effectiveness and mode of action of a combination therapy for heterotopic ossification with a retinoid agonist and an anti-inflammatory agent. Bone. September 2016; 90:59-68. Epub 2016/02/20.
7. Agarwal S, Loder S, Brownley C, Cholok D, Mangiavini L, Li J, et al. Inhibition of Hif1alpha prevents both trauma-induced and genetic heterotopic ossification. Proc Natl Acad Sci USA. Jan. 19, 2016;113(3):E338-47. Epub 2016/01/02.
8. Sorkin M, Huber A K, Hwang C, Carson W Ft, Menon R, Li J, et al. Regulation of heterotopic ossification by monocytes in a mouse model of aberrant wound healing. Nat Commun. Feb. 5, 2020;11(1):722. Epub 2020/02/07.
9. Mundy C, Yao L, Sinha S, Chung J, Rux D, Catheline S E, et al. Activin A promotes the development of acquired heterotopic ossification and is an effective target for disease attenuation in mice. Sci Signal. Feb. 9, 2021;14 (669). Epub 2021/02/11.

10. Rai M F, Hashimoto S, Johnson E E, Janiszak K L, Fitzgerald J, Heber-Katz E, et al. Heritability of articular cartilage regeneration and its association with ear wound healing in mice. Arthritis and rheumatism. July 2012;64 (7):2300-10. Epub 2012/01/26.
11. Hashimoto S, Rai M F, Janiszak K L, Cheverud J M, Sandell L J. Cartilage and bone changes during development of post-traumatic osteoarthritis in selected LGXSM recombinant inbred mice. Osteoarthritis and cartilage. June 2012; 20(6):562-71. Epub 2012/03/01.
12. Rai M F, Schmidt E J, McAlinden A, Cheverud J M, Sandell L J. Molecular insight into the association between cartilage regeneration and ear wound healing in genetic mouse models: targeting new genes in regeneration. G3 (Bethesda, Md). Nov. 6, 2013;3(11):1881-91. Epub 2013/09/05.
13. Chinzei N, Rai M F, Hashimoto S, Schmidt E J, Takebe K, Cheverud J M, et al. Evidence for Genetic Contribution to Variation in Posttraumatic Osteoarthritis in Mice. Arthritis & rheumatology (Hoboken, NJ). March 2019; 71(3):370-81. Epub 2018/09/19.
14. Hatzikotoulas K, Pickering G A E, Clark M J, Felix-Ilemhenbhio F, Kocsy K, Simpson J, et al. Genome-wide association and functional analyses identify CASC20 and KIF26B as target loci in heterotopic ossification. bioRxiv. 2019:845958.
15. Miki H, Setou M, Kaneshiro K, Hirokawa N. All kinesin superfamily protein, KIF, genes in mouse and human. Proc Natl Acad Sci USA. Jun. 19, 2001;98(13):7004-11. Epub 2001/06/21.
16. Susman M W, Karuna E P, Kunz R C, Gujral T S, Cantu A V, Choi S S, et al. Kinesin superfamily protein Kif26b links Wnt5a-Ror signaling to the control of cell and tissue behaviors in vertebrates. Elife. Sep. 8 2017;6. Epub 2017/09/09.
17. Huynh N P T, Zhang B, Guilak F. High-depth transcriptomic profiling reveals the temporal gene signature of human mesenchymal stem cells during chondrogenesis. FASEB J. January 2019; 33(1):358-72. Epub 2018/07/10.
18. Cai L, Brophy R H, Tycksen E D, Duan X, Nunley R M, Rai M F. Distinct expression pattern of periostin splice variants in chondrocytes and ligament progenitor cells. FASEB journal: official publication of the Federation of American Societies for Experimental Biology. July 2019; 33(7):8386-405. Epub 2019/04/18.
19. Steinert A F, Kunz M, Prager P, Barthel T, Jakob F, Noth U, et al. Mesenchymal stem cell characteristics of human anterior cruciate ligament outgrowth cells. Tissue Eng Part A. May 2011;17(9-10):1375-88. Epub 2011/01/21.
20. Blau H M, Pavlath G K, Hardeman E C, Chiu C P, Silberstein L, Webster S G, et al. Plasticity of the differentiated state. Science. Nov. 15 1985;230(4727):758-66. Epub 1985/11/15.
21. Yaffe D, Saxel O. Serial passaging and differentiation of myogenic cells isolated from dystrophic mouse muscle. Nature. December 22-29 1977; 270(5639):725-7. Epub 1977/12/22.
22. Reznikoff C A, Brankow D W, Heidelberger C. Establishment and characterization of a cloned line of C3H mouse embryo cells sensitive to postconfluence inhibition of division. Cancer Res. December 1973; 33(12):3231-8. Epub 1973/12/01.
23. Tang Q Q, Otto T C, Lane M D. Commitment of C3H10T1/2 pluripotent stem cells to the adipocyte lineage. Proc Natl Acad Sci USA. Jun. 29 2004;101(26): 9607-11. Epub 2004/06/24.
24. Shea C M, Edgar C M, Einhorn T A, Gerstenfeld L C. BMP treatment of C3H10T1/2 mesenchymal stem cells induces both chondrogenesis and osteogenesis. J Cell Biochem. Dec. 15, 2003;90(6):1112-27. Epub 2003/11/25.
25. Katagiri T, Yamaguchi A, Komaki M, Abe E, Takahashi N, Ikeda T, et al. Bone morphogenetic protein-2 converts the differentiation pathway of C2C12 myoblasts into the osteoblast lineage. J Cell Biol. December 1994;127(6 Pt 1):1755-66. Epub 1994/12/01.
26. Puchtler H, Meloan S N, Terry M S. On the history and mechanism of alizarin and alizarin red S stains for calcium. J Histochem Cytochem. February 1969; 17(2):110-24. Epub 1969/02/01.
27. Gwak J, Hwang S G, Park H S, Choi S R, Park S H, Kim H, et al. Small molecule-based disruption of the Axin/beta-catenin protein complex regulates mesenchymal stem cell differentiation. Cell Res. January 2012; 22(1): 237-47. Epub 2011/08/10.
28. Yan H, Duan X, Pan H, Holguin N, Rai M F, Akk A, et al. Suppression of NF-kappaB activity via nanoparticle-based siRNA delivery alters early cartilage responses to injury. Proc Natl Acad Sci USA. Oct. 11, 2016;113(41): E6199-E208.
29. Duan X, Rai M F, Holguin N, Silva M J, Patra D, Liao W, et al. Early changes in the knee of healer and non-healer mice following non-invasive mechanical injury. J Orthop Res. March 2017; 35(3):524-36.
30. van Kuijk A A, Geurts A C, van Kuppevelt H J. Neurogenic heterotopic ossification in spinal cord injury. Spinal Cord. July 2002; 40(7):313-26. Epub 2002/06/25.
31. Shehab D, Elgazzar A H, Collier B D. Heterotopic ossification. J Nucl Med. March 2002; 43(3):346-53. Epub 2002/03/09.
32. Descamps B, Sewduth R, Ferreira Tojais N, Jaspard B, Reynaud A, Sohet F, et al. Frizzled 4 regulates arterial network organization through noncanonical Wnt/planar cell polarity signaling. Circ Res. Jan. 6, 2012;110(1):47-58.
33. Nalesso G, Thomas B L, Sherwood J C, Yu J, Addimanda O, Eldridge S E, et al. WNT16 antagonises excessive canonical WNT activation and protects cartilage in osteoarthritis. Ann Rheum Dis. January 2017; 76(1):218-26.
34. Marikawa Y, Fujita T C, Alarcon V B. An enhancer-trap LacZ transgene reveals a distinct expression pattern of Kinesin family 26B in mouse embryos. Dev Genes Evol. February 2004; 214(2):64-71.
35. Huang Y, Wang X, Lin H. The hypoxic microenvironment: a driving force for heterotopic ossification progression. Cell Commun Signal. Feb. 7, 2020;18(1):20. Epub 2020/02/08.
36. Bensaid S, Fabre C, Fourneau J, Cieniewski-Bernard C. Impact of different methods of induction of cellular hypoxia: focus on protein homeostasis signaling pathways and morphology of C2C12 skeletal muscle cells differentiated into myotubes. J Physiol Biochem. August 2019; 75(3):367-77. Epub 2019/07/04.
37. Dominici M, Le Blanc K, Mueller I, Slaper-Cortenbach I, Marini F, Krause D, et al. Minimal criteria for defining multipotent mesenchymal stromal cells. The International Society for Cellular Therapy position statement. Cytotherapy. 2006; 8(4):315-7. Epub 2006/08/23.
38. Zhang Q, Zhou D, Wang H, Tan J. Heterotopic ossification of tendon and ligament. J Cell Mol Med. May 2020; 24(10):5428-37. Epub 2020/04/16.

39. Sugita D, Yayama T, Uchida K, Kokubo Y, Nakajima H, Yamagishi A, et al. Indian hedgehog signaling promotes chondrocyte differentiation in enchondral ossification in human cervical ossification of the posterior longitudinal ligament. Spine (Phila Pa 1976). Oct. 15, 2013;38(22): E1388-96. Epub 2013/07/26.
40. Wang X, Li F, Xie L, Crane J, Zhen G, Mishina Y, et al. Inhibition of overactive TGF-beta attenuates progression of heterotopic ossification in mice. Nat Commun. Feb. 7, 2018;9(1):551. Epub 2018/02/09.
41. Meyers C A, Casamitjana J, Chang L, Zhang L, James A W, Peault B. Pericytes for Therapeutic Bone Repair. Adv Exp Med Biol. 2018; 1109:21-32. Epub 2018/12/14.
42. Kraft C T, Agarwal S, Ranganathan K, Wong V W, Loder S, Li J, et al. Trauma-induced heterotopic bone formation and the role of the immune system: A review. J Trauma Acute Care Surg. January 2016; 80(1):156-65. Epub 2015/10/23.
43. Hashimoto K, Kaito T, Furuya M, Seno S, Okuzaki D, Kikuta J, et al. In vivo dynamic analysis of BMP-2-induced ectopic bone formation. Sci Rep. Mar. 16 2020; 10(1):4751. Epub 2020/03/18.
44. Day T F, Guo X, Garrett-Beal L, Yang Y. Wnt/beta-catenin signaling in mesenchymal progenitors controls osteoblast and chondrocyte differentiation during vertebrate skeletogenesis. Dev Cell. May 2005; 8(5):739-50. Epub 2005/05/04.
45. Wu C L, Dicks A, Steward N, Tang R, Katz D B, Choi Y R, et al. Single cell transcriptomic analysis of human pluripotent stem cell chondrogenesis. Nat Commun. Jan. 13, 2021;12(1):362. Epub 2021/01/15.

SEQUENCE LISTING (50 sequences)

SEQ ID NO: 1 - DNA, 53 bp, synthetic construct
  source 1..53: mol_type = other DNA
cttggctcttcaagctcataactcgagttatgagcttgaagagccaagttttt

SEQ ID NO: 2 - DNA, 53 bp, synthetic construct
  source 1..53: mol_type = other DNA
ctgacaacctgctcatcttatctcgagataagatgagcaggttgtcagttttt

SEQ ID NO: 3 - DNA, 554448 bp, Homo sapiens
  source 1..554448: mol_type = genomic DNA
agttaccaagctcggtgaaggagacaagttcccacagctgactcggctcggctctcccaccttcccggcagcggccgcgagccctgattgtatccctcgctttcctcgtgggggagcacggactgacttggctgaagaaaatgccagttctgtggatgtggccgtgacaagaggacgtgcggctggaagaggcagaaggggacgaggaaaagcatgctttgaagagaagaataaaccagcgaccccaaccctttctgcaaattggtgctattacttgtgggatccatttgctttcattccctcccaccccaccgctgaagaaaccttgccctgagggctgagagccagccccctgcagccgggggacgcttctgggttggaggaccttctggatgtagcgtcggtggaacctttagatactctcctctggaaaagccaccatgaattcggtagctgggaataaagagaggcttgcggtctccaccaggggcaagaaatacggggtaagttgtgacggtacgacgcggagacgcgttaccagacccatctcggcggaggtccccctttccccgggatcgtgcggccccggccccgagctctcccccgctgcagaggcgcccccggggctggcggggttgtgagtgcgcggaggcgggtcggccgcggggacgcccgcacgctcgcctcgctctcggaattttttcagccctctcgttccttcctttccacgcacccgtaacttttgccgcattcctgcacttctaggcagagtgaagccgaaggggagggtttcccatgaatgctgggcagtacctcggatcgtttagctggagccgtgagagcctctcgtttacctgcaggatccggagagttggaccccgtatgaataaaaatcctgaaatcacagccctccccctaccccccccatagggtcttccaggattttgttcccgggatcttgctgggataggtgccggcttcaaaagcgtggggcgctgaacctatggatcccccccgccttgcagaagccgtggaaacggccccgagcgagtccccttcctgaccccaggaggaggccaccggggaccagcgcaggggtcacctgggcggtggggactcacttaaggacaattaacgagacagacggagggcaatttggccgcagggcttggagaggtccccaaccgactcccgtgggcggttcgagcgggtacttggtggcgcacgtatgacccagctcctgggcgctgcagcccgccgccttgcagcccctgacaccggcgtgtcttccccgcaggtgaatgaagtctgctcgcccaccaagcccgcagcgcccttctccccggaaagctggtaccggaaagcatacgaggagtcgcgcgccggcagccggcccactcctgagggcgcgggctcagcgctcggctcctcggggaccccgtctcccggctcgggcacctcgtccccgagctcgttcaccggctccccgggacccgcctcccccggcatcggcactagttcgccgggctccttgggcggctctccgggcttcggcacaggctccccgggctccggcagcggcggcggctcctcccccggctcggaccgcggcgtctggtgcgagaactgcaacgcccgcctggtggagctcaagaggcaggccctgaggttgctcctcccggggcccttcccgggcaaggtgagcgccgcgcggggctggctggggaggcgccgggagggcggggccgggccgccacccacagcagctgctcagcccgccgcgaccttgcgcgccggctccacgcgagagcccccggcggcgctggggatgctccacacctcacggggctctagcacgcggggcgacccatgccccttcctcagccaggccgcccggggggcaggaggaccgagtcccgagcgcgaaggggcgcccgtggccacaggcctcacggcccacgggggaggcccccaggtggtctctcctgccgccccctcccagctctccctggcggctgcaggctgcgctttcgatgtttctccccacccccacctgtgatcctttacaaaaatgtcagcgggagctgtaaaagcaagctgatgctcggagctggcatttcccactgcctgtttgtggtccatcctttccgcggttgcagaaacagaaacatactcgaaagccagcattttccccttctcagtctgtgtgtgtgtctgaggaagatccggaggcgggtggctcttcggagcagtgctccctcctggcctgctcctgcgccaagcacactggttcctccatagcaaccctgcccgcagtgtgtgactggcccgagcccccaggggatagcaatgcgattgtatttgcactgttgggtccaagtactatcaaatgatcatatttactcggccacttcaaagagtttttatcagtggttagagagcaatatcaaggaaatagagtggattgctgtagaggtttttgacactgttggttcaacgtcaatttctggtttattatttccgtgactttagaaatgaaatactgtgatttcgagtaggcgtttaggaatgactgcgtctgctggcccaacctgcgtatgcagatacacacgttgatgttttcataggcaagggttaaattcaacaaatgcccacagacgctgtgaaacttaaaatgggggaaatgaccaccaggagaattggttttatgaatgcagaacttatctcaagaataatgaactcgtggatggttgtcagtgtaccgtttttgtagtttgatacatctgccgtgacatcccaaggatacatctcaaggaatcaaaaagcttatttcgctcttgcgtgctagaccttccgatttaacaccgtttcttcattcacagatttatttgctctcgtgatccttcatcaatattcattgattttctactccatccgaggcactgtgtcaggcacagcaatgaaaataccaggtccattcatgcagtccttgtccacgtggagcttagattctagtggaggatacagataacaaccacaaaatgcacagttcacaatgtcttcacatttgtggagggaatgtagggtgctgtgaggttgttgaactggatgggagcatctgataaagatggaaggaccttggttcttaaagatctagtagctgatatttggcagtcctaatacgttacagcctaccaaattattttagacctttcttgaggacctattcttataataggcttattgtggctttgggtgttcctatatgcaaaggccgatcaaaatacactcttctcatttaaaaaaagaggaggggaaggaaaatctacagaggaaacaaatgttgaaactcatacgcatccatcatgttttatggagtcctgtgaccagctggaatcttgtttttatagaaacagcctggaacattcacttacagtgtcacgggaggcagctcaatatatttgccaattttatgtatgtgataaggtaaaactcttgttggtaaactgattgtattgtcagagtgaggtgatggccccagaagaaacactggatttgctgaacccccatgctctacaatgacttcgagtgatccaaggacatctagagaagacctggcagtcatgggggcagtcacaggggatcactttaagtgcatacgtgaatgtcacatagtaccacagtcgcctgagttttatatgtgaagcagcacagtaaagcgtgacatttggtgcaagggcatagacagggctcagccaggaagaaggatgctttgcatcagctcattgttagtaatgagatgtggggcctcaattttaactacaaaatttctgcaagcctttgtgaataataattgtgtgtgtgtgtgtgtgtgtgtgtgtgtgtggtgtgtgttttaagcatttgtaccttgcatttaggtacaatttccattatacctttagcatttgcaaccttatagccaaacagttgccatgttctctggtgtaccatggatggaggccatgtaacttggataagacttttcttcttcccggagcaatattaatgaacaaactgtggaccactgtagccctcaggcacagaaggagttaagtttcattagaacaagaggtgtcactgtgactccaacatgcagttcgctcagttcgctctgaagagtaagagtctggaagataaagacatgtttttgaggagtaattaacaaaaatcatctgtgtaatttgcttaagatgcttacctgcatttgggaaatattttcttaaatagagtgttaaattctactaggtggtattaaatgtctcctaggtagatatttaaaagtcaaaagcagaatagcacatccaggaaccttaatattttaggatggatttggttttggttcttcttcaccactgatttactttgtgacattgggtaaattagttttcctctctactttttaactttcctattaatatcctaaggaaaaaaatgaatgagactattaaaacgtcattaaaatgatccaaggtaaggtctgaaaagtgctttcattctttagagaaagatatgagggttgatgattattaatgagctaagattctgttagatttatgttttacagaatttaaggtttttcttataagatattactcctgtcagtttctaatttcatctgtatattttctaaacatgctgccatatgagttctcacactgtgcctgttggtaggtagcaagccctattgaatcccccgttctgtctttggaacagttggttaaggaggggaggtgaagtagtagagagcccattccgggtatctggttggttccaggagctagtgcctggctctggtggcctgagaagaaccatcttattctgagcactccaatggaggatagggcttcatggtagaaaatgacattatttgaacgtaacggagtgggtgatagtgttggctgaggtaggaaataggaggagacatggaattggatggagctcagagggaaggatgatcatgagtttggttttccatgcagcgagtctgagctttctggaaagagatggaggcagatttaataataaaacactttgtttttggctatctcaagactggcgtgtagaagtgacagctgtgagctcacatagctctgctgttgatactctgtattcatcctttccgatagcaacttacctggtgagtagacgtttgtgcttggtggcagattgtaaaacactcagattgacttttattaccttgatcagtacaaaaagtacttactgggtttatatcgtttctcttttggtgccggtgagtggaagtggtcggataaaagaatgtggacgtgtaaagtgttgagattttaagtgagaatggcccttttacccactgtagccttccagtgtgtgaatacaaaaccatttcatgtccaatggcaagagcatctttcctgctttgtacacagtcagggcactgagccagaaataggggccaaggaacgaattgctcaattttgggctagcctagatcattctgatatctgtgacagaacttttgaatggactgggcaagtcctacgaaacaacagcccaacgaaattccctggagtaagcagtaaagctccaggttggcaaaaggttatcagacatctgttcatttccatatcaataaaagaaaatcttttatgtaaaaaaaaaaaagtgcagaactatgttcctatctgattgtctctcagtcagatattctgagtccatttatgccccagaaatatcaggaagattagccagacatactgagaagggtggccaggaatcacagagatgaaagaaaggaatgcgtcataggggttaaaaacgccaaacgtggactctaaatagccggagaccaagtaagtctagacttgaggagatatagatatccccacatgcatatttctgtattttgccagctccaaaagaggggtatggaaaaataactagacgcaaaaagtcccccaaaagccatcataaaacattttatagataggataaaacagacattgcatttcgagtacttattaattataagggacttctagctgaaatcttctctttcttctaagaacatgtggctattttcaaaaagcttcatttgagtctttctcatatcagaagtattttagataaaggagcagttagtagataatagcagtcatgaaaaagtcctacagcatttatcatttgaaaatttctgaaacattttgggagtttataaaaacattcccaggagagacatgtgagcagtaatctctttttaaggcttagcaagctgtggaataatggcagttcattctaccagactattaattgtgaagcaacatggtcagtttttatagtgacttaattcactttgcaaaaatccctggcctgcaataattccttccacacccattgcagataggattactacattagaaatgtgatttttaaatggctgaggctggtagtttgtcagcatttggaaggattaagtcaattaaaatggaggcaacatcagttgccatttgttatttggcattatatcacagattgtaccatgagtgggccaacaatagcgatgatagtaataataataatatgtaataaatggctaacaacgattgtcctacataccacgaactacactgaaacacacacacacataatctcatatattaaaatgaagatgaacgtgattttttcttttttaccctggaattccaagtgcttgatgtggttaagatcatagaaggaagcatgaagaaaaaatatgcaaggaacagagaaatccaatcacactttcccctagaagctgttaagggtccctgtgagtagaactgactgagtgagaggcaccggctcgagatggttattatttttcctgggctcacagatgagaattttacttccagtgagtggggaggttgggggaaagtatgtgagactgtcaggttctgagttgaggaattgtcttggctggaatgcaaggggcggggggaaggaacctccttatatttacgtgcacccattggagaccctgttgtcatcccttcctgaacagaaaaccctgcccgagggccccgtcctgaccttctgcgaggaagagttcttcagccggccatttcagtgccccatcggcagggcggccagacctctgctctgttttgtcctcaaaaagattgcaaattggctggtgtctgggagggttcttggtcattttgcaggaatacaagacaaatttcctttttaccactctctgcagtcacaagctattcatcagcatcctttctttcctgtttctcgtctatggtgttattgtggcgaaggagcactgttgagaatgtgctcccaatcgctcttttatacctatagatgcacccatcagaaatatcttttttttttttttttttttttttttttgagacggagtctcgctctgttgcccaggctggagtacagtggcgtgatctcggctcactgcaacctctgcctcctggattcaagcaattctcctgcctcagcctcccgagtagctgggactacaggcgcccgccaccacgcccagctaatttttgtatttttagtagagatggggtttcaccatattggtcaggctagtctctatctcttgaccttgtgatccacccgccttggcctcccaaagtgctgggattacaggcagaaatatcttattttaaagtacattcgtgtagatgcaaaaggactggggatacacctgtattcctaatgtacttttgaaatatttgtcaagatatcaactcagtttgtatccatcattggcttaccattgcctttggaactgctccagagcctatctgagaaaattggaaatgagtgattgttaaaaagatgtttgtccacctccaggtctcaaagaactcacctatgttttcttctagtatttaaatagtgtcctttttaatatttagatctctaatccattgagagattattttggtgcaaaatgaaagatatagatcaaatttcatctttctctaaatgtctatccagttgtccccactttattaaaacattcttcttacttgcagacttcttcttgtgaaaaaaagaatttatctttctcacattaattgaagataccaccattgtcataaatcaaattttcagttgtatctggacctattacaggatcttctagaatgttctcactctgttgtccaggctgggttacagtggcacaatctcggctcactgcaacctccgcctcccaagttcaagcagttctcccgcctcagtctcacaagtagctggaaatacaggcacggaccaccatgcccagctaatttttgtattttcagtagaaatggggtttcaccatgttgtccaggctggtcttgaactcctgacctcaagtgatctgcctgccttggcctcccaaagtgctgggattccaggtgtgagccactgcgcttggcccacactattttaattatggaagctctgtagcatgttttcatgtttggcagggctagctctctctccctcaaatagtgcctttcttttctaggagtttccttgcctaactccaatttttttttttgttaggaccgtgttgaatgtatacattaacctgggggaatagttggcatctttatggtgttgaatctttcccaagaacatggaataccttttcatttgaacaagtctactttttagcaatttttaagagtttcttcatataggctttgcacatttcttgttaaactttttcttaggtattatagcttttgttgctattgtaaatggagtcttcactttcattatctcttttaattgataattatttatgtgaaggatattgatctacatgttttatatcccgtcgccttattaaattctactatattcactgatttttaaaaaattggtactcttggattttcaaaaaattttgtcttcttcaaatacagatatcattactctcttcctttgctatttttatgcctctaagtgttttctcttttttgttacattggctggtactcctgacacaatgttacataatagcgatatagtgggcatgtgtatatatttttttctattaagatgttggcttttggactgagatctgtctatattttttaaagttaagtaaatatccatcaattcctactttagtgttttattaggaatgggtattatattttgccaaatgtcttttcagtatttagagagagaatcatgcaatttttctccttagatttgttaatattgtgagttattattattgattttctaatagtgaaccatccttgtattcccataataaaccccacttggccacagtgcattttgaaagatatgcttctggatccaatttgctaatatttcatttattgtttttgctttgatattcatatgccaatgaacatttttgattcctgtttatgtgccagttctagtactatgccacattataatccaaataggaaaaatactaaaattcctgccctggagcaactcacagtctagtgtcagagacaggcaaggaacgtggcgaagcgtaagcgttccagccacaggaaacggcaggcataggccaggaaggggtgatgcgtgccccctacatatggggaactgaagtcgcacatggtcaccatacacagtatttgtatgagtgcgtgacaggctggaaaggaggcagatggaggatgaaaggccttgtaggctataggctggactttatcctgtaggacgtgggcagccattggagggcactcatgaagggagtgaaatgatcagatatgcatttaagaaagattgctggccaggcacggtggctcacgcctgtaatcccagaactttgggaggccaagacgggtggatcacctgaggtcaggagttcgagaccagcctggccaacatggtgaaaccccgtctctactaaaaatacaaaaattagccgggcgtggtggcccacacctgtaatctcagctactcggggctgaggcaggagaatcgcttgagcccgggaggcggaggttgtagtgagccaagatgatgccactgcactccagcgtgggtgacggtgcgagactccatctttaaaaaaaaaataaagattgctgtgagaatgagcaagaagatgggttggaagagtggtgtcaccgagaccagttgggaggccccttgcagtggcttgagtgaagaatgacacagactgaactagggtagtacagagggaagggagaggcagctccggcctgacacatatcatatgtagaaaacccgccatggggagctgctgagatacggggccagagggagaaaagatgatgcattctcccaggtttctggccagggaaagtgtgtgggtggtgctgccagttatggagatgaagaatacaggcagagaaggggttttgttattgtgagcccagtgttcgaggatggctgtggatgttaaattgattggggtctctagagcttgaggtggaatggtccaatgggctcctgttggcgctctagagcggcttctgaggtggagatatggatctgggggatgtcagcgtagagaaggtgatggaatccacagacggcatgagctctccacagatgtgtggggtgagacgacagacagctgaacatgaagtggtggagaccattgacatcgaagggaccagtggcctgaggagctaagaagacagaccaagaaggagggaccagaaaagagggatgaaaaaccaggagaagacagtgtcatgggaactgaggaaggagtgagcttcagggcataggggtgacaaaaggtctgatgccctggagaggtcaaggaagtaaggactgaggttttctttgaactggcaaggaggaggtcattggatgtctttgttggaagaatttctggtgccctggagaaagccaatggcattgtgtccaggaatagattgagaggtgaggacatctcaggcagcatttgagttgctgaggacactgagatacaagagatccacttcttgaggctcttattatcttaaaatgaagaactacaatcaacagacttgcgtgcaaaaccaggctccgtcacttagggtgtgaccttgggcaagccttggtctttctaaacgtggttattctcatctctacagtgggagtcatgacagagccccaccaggaggatcgtgaggattaggtgaaattgtgagatgctagtcaaccatcgctttctgttattattccagtgactttccacaggaagttgaattttatataagattcctaccctccttccttccctccttccttccctctttccttccttttttccttccttccttccatctgacacgaaaatggagaaacagcagtcagagaaaatgaaagcattcagtgcgtctttgtttcttcacctccaagtggataaagcatctcattcttatttattcatttgtagagttgtcaccacagaaagtttaagggagctcagtggatgtaaatagcgactcctttgggttgaggtgccatgaatatggattgagagttttttgtcacagatggaaatcccttctttaagcccggcccctctcgtagcccctccagggagacttgcagatgtggcatttggcatttcggctccggggaatgagggagagcagatttcctccagtgactgcgcatgcgatgtgcagatctgagccgcaccaggaatttgggcttatctgccttccaatccagctttatctgtctcagacggttttctttgcagttgtactttgctgatcctatcacatcgattccaaccagaccccatgggaagtctgggaataaagaagtcaccctcccccaccaagcaggatatcctgcacatacatcagctctcagggctggaggtgaccgtggaggagagggatcctgtgagctctaatacaaaaaaccgagacattctgaacgttgctatagaggttagcaaagcagaaggctctgagggtagagtaagtattattaattttttaaatatgcagaacgataaatatgtcttaagtgttatagaccaggttacagctgagggactattttgattttccttttctacttattggagtttacgttcaatactgttgccaaccacaaaaagttattggaacaaattttagctctccacacagcatggttctaaaatctttgatggttcttacgtgtaaactttctttttatataattgtttttttttttgcttgaaagcatgagctgcaaataataaattaaaatccgcttttctatcacaggggtgacaaatagaaacttttattttgatatgtccttatctaagtgatgtctgaggtctgtatatgctaattcaggattttttttctgagctaacctaggaaccgatagaacttgagatttttctgcagtgtaattttgtctttgagttggcagtgatgagcagctacacttccccatgaaactctatcatcgtatttagagtggttgctttctttggggttataatcactacttcccaacccttcctccacctaactggtggcttcacacaagaatgggagactcacctattaactgattagaagccagcaataacaaccagcaccaaaagctgtcgagctatctaaccaaatggttgtacagaaaataaacagctgaattcaggcaaacaactggaagcagccaccattgtttaaaaaaaaaaatcacctgcccagttcagttgtgtaactttgcacagcagggagtctcagtcctaagcaggtggcagagtgtcttccccatggtaccatggctgggaattagagcatcaggtgtcctttaccaagacaggcagcgtggtgatgggggctgagggatagatgggaggaggatagaaaggagaggaataagaggggaggaggaggaggacggatgagagagagggcgaggaaacaaagaaatgggtggtatacgcatccaaggttgtctacaatcccagatatttaggtgaaaaaggactgtccttggatctggggacagaggtgcagtcctgcttccagcactgataagcattatgatcttgggagaatcacctagctggcctgtgcttgatttttcttttgtaatctaagagcatggtagtcggtgggctctaagcttctcccaagcctgtgagtctctgtgaagctgaggctttgggagtccactccgtgaacccagattccacagggatgtgcctggcaaaatccaagtgggtttctggctgaagctgttctgtgggctgccatgtttgtgggacatctcatctgcagccgccgcagcgacctccttgtccgtccagccaaggggagggaccggaagccaagcggaggggccggtagcgccgtcgttgctgatgcttctgcttttggaattcggatcataaactgacagggttcttcctgtttcttaataaagctatttgttttactgtctaatgtgtttctaagcagaaatagacaaacaaaaggacaattgattctagaagagagatttagtatggagtatttgaagaaaagtattgccttagaaataaggatgttttgtagttaattttacattaaaagttctgccatattgattaggatttagaaataacatacgaagagttcttcctgagtagcagtataggaacaccagaactctataaacattttattcatcattcttcatctgatttttttccaaaatctttttgctccctttgatttctctctttttttctgctctttcaaatgcctagacagagccatattgattaggccagtatttacatatcacatgcccctgacgtgggtttaatgccccgtagtgtttgatgctgtggtctgggaaagaatggaacaggtagctgcccgctgagtcaacgaggcccatgcagttatcatcgatttttatttttctctttaatcatttagccaaggttgcctctttaaaatatctacttcctgggggatgtttccctgactcttatttcaaatctaatactttgtatttgagtctaaacacaattcagggaatatagctattaaaagcagaacttgattttgtttaactagtccagagcgcgtgatggctttggagcagagtggagaacaggcacagaggagcacgagccccaggaacaccacttggtgcccctccctcgtccttccaccgagctctctgcacgtatcttaccagggcgtgaatggagcattctgcagccagacacatccaacccacagcaaaccctccatgcaagcttgcctgtgtcctcagacattctaccctttatttctcctcttgttctttgcccctaagtttgtccatgcactcgactttctaacgggccatggtgtgtgtgtgtgtgtgtgtgtgtgtgtgtgtgtgcgcgcaagcactttgtggaggccctgaaggcagcatgtaaggtggtaacacggtagacattctgccccaggtttcagacattgttaggctgaagcttttattggaggtcaaggcagctaataaagtgggccgtgcaattacaagagcattcagcagagaaggatggctgaccctctcggcaggctgagagcagaggaagcggttggcagctcctagtcctcccatgatggctttacaagcattttttgcagccggggtggtaaatgcgatacaaaggcatggtttcaatatatccaatgaggcactctgcttcctgtgtgaggcatccacttgggggaaggaagttgcccggctgtgggctttttgtggtggtggtttctgctaatttaccttttttatagagggctcataattattagggatcctccataatgcccctttatggtggtcaggaaggagataacaaaatgatgcagaggtttaggaggcttctccagggtcacccagaaaacctctggattctgaatctccttcaaagatttaagaggatttatttatgctgctctcttgcccatgtggatctccttgacactacactccgtgagcgtagttaatgtcctgtcttgttcactttgttttttgtttggtgcctgtgtaccaagtagatttctggtgttttgaaaaaaaaaatcacccgtccactgctgcataaccaaaacgtcactggtgtgaaggaagaggatgatagaggatgggacggtggtgacaaatggcgggatgggagatgatgcctgggtgagtcctggaaagtgccgtgatgccatcccactgacatggcctcctgtattccagcaaagagtgaaattcacagggagcacagagtaagagcagcgccttcacctcggtggagcttagtctaggcatttatgggtcggctggtttgagggtccttgcatttcttgtcagtcaatacgtccttgttttggctaagtctcatgccctcatatccacttctacccttgcagaataaagacatgtgggaatgctcactggatgcttacaattggttccaggtgttccagggacgaaacttatcagaaccaaacatagagggcaaatgtcttagccaattcatgctgctataacaaaataccacgaactgggtggcttataaacaacagaaatactgatttctcacggttctggaggctgggaattctgagatcaaggccccatcagattgagtgtcttgtgaggtctgctttttgattcatagatggcactgtcttgctgtgtcctcacgtagtggaagggactggctagctctccagggtctgttttgtaagggcaggaatcccaattatgagagctctgccttcatgacccagtttgctcccaaaggcccacctcctactaccatcactttgggggttaggtttcaacatgattttggggagaacataagcgttcagtctgttgcagcaagcatgaggtcacttgtctagacactgacccctcaggcagtgttcatgtttggtttaatttttccctttatctggtaattgattctgcactgtctccattatttggtgagatggtaacatgtgattacatcccaatggagttgggcatgagaataagaaagaaatctccctttaaaggctttggactaccttggagtttgaagagagtggaggaatgcagtgagctggttttgatcttttggtgaaagtgacaaggaggcaggatggtttttccacggacattgacagggtcgtgctggttctcccaaagagaaatagagtagagttcatcacattagttaagagcacctcttcagcacattatatctcttcagcacatcgtttaagagcatcgtctttaataattcttacatggggcccgcacggtggctcacgcctgtaatcccagcactttgggaggccaaggcgggcggatcacgatgtcgggagttcgaaaccagcctgaccaacatggtgaaaccccgtctctactaaaaatacaaaaaagttagctgggtgtggtggcacatgcctgtaatcccagctactccggaagctaaggcagaagaattgcttgaacccgggaggtggaggttgcagtgagctgagatcgcgccattgcactccagcctaggcgacagagtgagactccatctcaaaaaaaaaattcttacatgggacaaaaatcactatcctatgtcaattgaaataaaggccattagtttttaacactgtataaattgccttttctcctgggaacttcagcatattcttttaaattattagcattttataatcatagaacgatggcatagagggaacctacagggtgtccagcattgcattacagttccctgatgaagagcatggttcttggggtctggccatcccatcaggatttgtatattttgctctgccgcataccagctctgggaacctagagaaggccttaaccattttccgtgttggtttcctcgcttgcacgatggtgttaatcataataactgcttcacaggcgtgttttgtctgctgcatggtagtcattcattaaatgtgagtatccaagctcccatcccaaactgccagaagggaaaagtaaaacttacacttttagacagcgacctcctgactccagggttcattccatctcattaacagtcagttcattcatttttcatttccttatccatccacctgtttgtttatccactcatctacctgtccagcatttctttggccttcaccgtacattcgtgtgtctagacttggtggtggggatgtaaagatgactaagacgcagcccttgccctcaagtccctcccagtctggtggggggggtgggtacagaagccacgtggtaagtgcagagttaggacacttggggagcagccagcatggctccgggctgctggaacattgcatctttcttttcttacaggccccgcctaagaagtgtcatggctgggagggagtcggaaggggtagcttcctagaaggggtgatgatggagaggagttagtgagagaagactgaggaaggtgaggaatctcatagctagagaccagaaacggccttgaggggctgcaggaacccaaagaaatgcagcattgacagacaggaggtgtccaaagtgggtggcccagctgggcatggtggctcacacctgtaatgccagcaatttaggaggccgaggcgggcagatcacctgaggtcaggagttcaagaccagcctggccaacatggtgaaaccccatctctactaaaaatacaaaaattagccagatgtggttgtatgcgcctgtaattccagctacttgggaggctgaggcaggagaattgcttgaacccaggaggcggaggttgcagggagccgatattgcatcactgcgctccagcctgggtgacagagcgagactccatctcaaaaaacaaaaacaaaaacaaaacaaagagggtggcccaccacatcaatttcacaagaagtgaaataacaatgtaagatttatatgtcagttttaacaagtgatgataccgtgtaatacatcagtatagcagtacgatagccatgttcatagcagccttattcacaatagctaaaatgtagaagctacccaagtgtctgctgacacatgaatgactaagcaaaatgtggtatatccatgcaatggaatagtatccagccctaaaaaaaggagattcaggcacaggctatgacctggatgaaccctgaggacattatgccaagtgaaataagccagtcacaaagacaaatattatatgattctggtgatatgagatacttagtgtagtgagattcatagacatagaaagtaggatggtggttaccaagaattggggaagatgaaaagaattctgcatatggaaggtggtggtggttgcacaatggtgggggcgtacataatgtcactgagctgcacgctgaaaaattattatgagaggtcaatgttatgttgttttactgggcgcacacacacggaaagtagtataagttgtgtcacaaaattgtatttgacggaagtgatatccctgtgcactggtcgcccagtgacggctcatgagggtaatcatggtaatacgtacaatctggccaccagagactcccaagcacgttacaagcagtctcacgtttgatccaccctatgagacaggccactttacgggtaaagaagctcagtgaggttagatgcctggagacgcgggccggggaggctgtggtcctgcactcactgcacagcccttcctgctccccggcctccctgtgaggctcactgcagtcccttggagggaaaggggatgctattgagaattggggccaggtgaatggctatagagggatgcaggagtcccccccacctttttctctcctttctcttacttccacggaccttctgagaatagggctggccctggcagccaagagccccttagctcctccctctgcatttgccgtggtacgacgtgtgacacgggccagacccacgctgctctgttctgcaggactcagtgcaagacagctcttttatttgtgcctgtggtcgttagaaaagttttacacgggcagggcagtcgtcatcactaagtaaacacattgagccggcaaatcagtctttgtgagagcagcacattaaatggttccctgcatagtagttactgatacattactataattacatcgcacattttgcagtaaactccaaaaaaatgatttattatctcttgggtgcttgacagcaatatgctcaatggcagcataacttttccaaatctgcccacacattttatgtgtatgactcttttggaattagaccaaatggacccttttaaagatctgctgagttaacaccaccttatatttatatggctgcgttcttcaggccacactgtactgggtcattgccactattttcccacctttctctttacacccctttaaggagtatcatggccagatgtggcgtggtgtctcttaaattcacttaatagacaaaagagaaggacatctctaacagtaatacaagaaaaaaaaagagagagaaggacagagagaccaagaaactctttttttactcctattcagcaactatgtatgtacttatttatttatttatttatttactgagacagaaccttgctctgtcatccgggctggagtgcagtggtgcaatcatagctcgctgtaacctcaaactcctgggctcaaacgatcctctcgccacagcctcccaagtagctgggactgcaggcatgtgccaccacacctggcccctcagcaactatttttacagtatcgactctgtgtcaggcgctgttctaggctctggacgcttgatgagtgtcaccagtgagcttaggacagagctgacgtcttctgcctattctttggctttactccccatagggcttttctggagaagggccctttggagcttgtgggatttcagggtttattgaaatttatttacctttttgcaggtgtctcatgcttcctcggttaaggaatgggaattatcataatgtataccatggtgtctggccacagatgaagtaccacagtcatcagattatgaagcctccaagcttctcttgcagaggactccttcaaaccactctcgtggactgtggctaactgggagtttctcctgggggcccattgctcattccttgctgtctctcccggttgagacttcccaccagggtgaaaagctagaacagtggcttttgtctttagcaaggccattagatggtacagtaactgctttcagatgctgctgatgtggcccagattcagcatagtgacccagaggtgaaaggctacatattccattacaacccctagccaatctgcctccagactctagtgcatttcagtagagaaaggaaggaggatagggtgacatacacactagatagcagctagaagtaagtctgggaaaatctaagaatggagcttcaatttctagagatgcttttgtaaagtgcattacttatgtgctgtgaacgtgatcatgatggattattcaggtaaggtggagacgagaacacagagaatcagaacagggaacttggaagaggcaaagtaaacaggcatggttgcctgtttattttgaggtttcgggtggctattagccctacaaatgccagctaagggcaaatttctgttggttgagattctttgagattctgtcaatgcaagattttttaaaaagcaagtataaaagatgagaagatgcagttttgtggcaaagcgtagaaagtcactaagtccacacatgattaaaaatagtgaagagaccataattcaagtcatatgatctcttttattgtaatcatatttactcaaaagcctcttcgtttgttccatttctaattgttttctcttcttgtgtagagttaaaagagtcacgggctttattgaagggtggagaaattttattttcagaaattttgcctcaatgtttattccctgtgagacactgacattttcttctcaaaacatatatatctatatctatatctatatatttagatgtctatatatatagatatctatatctatatatatagacatctatatatatagatatagatatatagatatagatatagatattttttttgagacagagtctcactcttgttgcccaggctggggaacgagctcagctcactgcaacctctgcctcccgggttcaagcgattctcctgcctcagcctcccgagtagctgggattacatgcatgagtcaccacgcccagctaattttgtatttttagtagagacggggtttctccatgttggtcaggctggtcttgaacttctgatctcaggtgatccgcctgcctcagcctcccaaagtgctgggattacaggcgtgagccttgtaattacaggtgccttgaaggcgcctggccttcaaaacatatttgtttagggaaaagtagtgtcagatctatgaaggtcatactggaagttgctaataagtagaatgccatatttcatggaaggagaccagagttcaggaagcatccttcccacagggtctatcatgggatttagttccttctttttctgcatcccagatgttcctggaggtgcatacttgctggtaagcctggagttggagggatgaaagctaccaaaggccctgatgggtgttatataagatgccacgtgtgagccactccccacaagacgccaacaagcagggaacctagttcagcactttcatacccagtctaaaggcttctaggaaactgtgggtcagctggcccactcctattaaccatgccttcatctgtagtggaaggaacatggctcacaggatgggctagcaggcgatggggcctttgactttcagattagtcttcctgcgacttttaacggtcatgtttacttttgaatataacctgggatgaagcatttatcagcctctggtacttttgtgaattggtagtttacagcgggcttactggtagccttggccagctctttgccataaaatctttaagcatagacacacaggggtatggccattccctttatttttaattaattaagtagtttctagagggagggtttcgttctgtcgcctcgactggagtgcagcagcatgatcctagctcactgcagcctcaactctctggctcaagcgatctgcttgcctcagcctcctgagtagctgggactacaggtgtgtgccatcatgcctagctattttttaaattgcttgtaaagatggggtcttattgtgttgcccaggctggcctcagatgcctggcctcacgcctcctgccttggcctctcaaagtgctgggattataggtatgagtcactacatctggcccatgagtcactgcacctgtcccattccccctgcctttattgattcctacttccgcctaggataacactatctcttaaaagagtgttgccaagaaaccccatttttttacattctatattgtattttaaagaggaaaccctatttagagatatttttgtgggaatggttttggagtttcaaacttctgaagaacctggactatgttgggggcatttacggtggcagtgcacacggctcacactgacgaatggctcggctgagcaagccagtgaagcagagggcaggagaggtgacttcctggcatcctggatctctgcaaatgaagttgctgtagcgccattatttacctcactgtatgtgaaatgaaggggtaggattcattgccttttggttttgattttacttgtccttaggggtgtgtgtgtgtgtgtgtgtgtgtgtgtgtctttccccctggccttctggtgacggataatggtgatggcagtttaggcctgtttctgattagtaaaatgacccttcaaatgagactaggagaaaaatgctctcctgaacctctggaaccctggtttttcctatcacaagtttaatggcttcaggtcctatgtttttagccgagaaaatgaaagactcagtcagcggggattagggttttttgtttagagagaaggtaaaaaggttacatgaagatttggtgtgggtttagactggggttagcctccacgtaggaaaggtctgaagatcgagaatgaggccaggttgtgcaggtgagcagagctatctttggcagctagattgggatgtttctgggcagagatatttgtcccttaggagtgtatcaaatcacagaggtcacatctgactgtcactgctttgttacaggagaaagacctgttcatcagaataattcctacgctttgagccacttattcaagtgatgctagtcacgttcagaaaacagataacctaccatgtgtttgtgctgtgctaggagttctagagctttcaagcacaaccgtatatccgaggttgactttggagctgtcatcgtgggtttggggctgtattttaaaataagaggagcggtgtcttttgggctttgcttttttttcaaatgcttttttctgagtcccttcagtgatccattcttgagctgtctcttcagtcgtcagtctcttggtagtctttattctaagtttttttcctttttaattgtagtaaaatatgtatagcataaaatttcccatgttattcctttttaagcgtatggttcagtggctttaagtaccttcatatcattgcacggccatcgccaccatccacccacttccatcatctcaaaccaaaactccaaatgcattaagcaataacttttgttattaaagtgtttaataatcactttggtgctgtttaacctctttaccctgatttcctccccctttcttgctccttttctagtagtttctactaatagatcacctgagtaagactgcccgtgtcaagcctggtgtcaccttaggttttggggataaaggctggtggtaccgcctgtgacgtgggcttgccacatgcagtgtctgagtggagggcaagtggggccggctctacagccatccgagcagacgggggctctgtcccttactcctcaggcacctgacgttggacttgcctctgggtaaataattcttatcaagcatttacttggaacaattcttaaccatgttttttttttttaaataattactgacatttgtactttaagctgtatacaaatgttcatatttgacagatattctaagcattagagatatttaatgaaaacttgtaaataggcaaaacgacatttaaaaagactgcccctgtctttgtgaaagcagcaaatagttctcttggctcccatttccccctctccactctaaaatatttttaaataaaatagcgtttgaaattctccagagaatgctttaaagagaaagatccacgtgacctcattaagtcattcattcacgtattcatttatcacacatttatcaggctcccaatatgtgccactttctctgtgttaaatactatggattcaaaaacaaaggaggccgggcgcagtggctcatgcctgtaatcctagttctttgggaggctgaggcgcgtggatcacctgaggtcaggagtttgagaccatcctggccaacatggcgaaaccctgtctctattaaaaatacaaaaattagccgggcgtggtggtgcgcgcctgtagtcccagctactcgggaggctgaggcaggagaatcacttgaaccccaggaggtggaggttgcagtgagccgagatcacgccactgcactccagcctgggcgacagagcgagactccgactcaaaaacaaaacaaaaacaaaggagaccccaacattggtcgtgagaagtttaccaaccaggaggggagataagtgtgtaaacaagcaaacaactgtcgtaaaggctgtggcacaagagtgggtgggtagaattcgggtaatccaggaggtgtcagaaagaccaggggtggacctttcatctgagccacgaggacaagcaggtgtttgctttggagacagagggtggacaggatgttctggagagctgcagttgcggggcagaggcagtgaggcatgaagcacctggcgcatggcctgtgcgggcctgggtggtgagggcaaagacagtgagcagaggaggcagcgcctggggggcctggccagggaccccaccccctgcatcctgatgaagaactgtaagaggaccatgtctgtgtgcctggataatcgctggcagcagcaagggaatttcgaagcaagatctcagctggagacaggcaagaggctgtcgccatgcttttaaagaagtatcagagatattttgcttttgaaacatttggcttcactggaactttcgtcttcctatgaaatattggaggatgtcagatcctcccccatttctaagagtaggagagactcatgtatctttctctttggggtaaacattcagcttcagatcctgcaggtagcagagagagagagagagagagagaggagtggttaagagtgtggccattggagtccagggagtctgcgttctaattctggctctcctcttaaatagtcctgcagcttgggcaacttactcaactgtgtccttcctcaacttccacatctgtaaaatggggagaacaccttcctttcagggttataggcaaatgaggtaataatctcttttaaaatacttagcccaagtaaatgctcagtaggtgctagctatcatctccagtttctatttcctgaactgtgaccttgactaaatgtggcccagtcctttaagagaggggatttgtggtcactttaaaaaaatcttcagctgtgctcatgtggtccggagtactgtgttagttttcctgcctgtggctcatgggccagtggtcaccatggaaatggtggtggtgggggtaggggtgggggaagagaaggaagccgagctacagagacattcatacacttgttcgtgaccacagcaggatttggggtccttctagagtcactgctgcaggattctttttgtttttttcttttttagaggtggggccttgctctgtcaccctggctagagtgctgtgaaacgatcacagtccactgtaaccttgaacaccaactgcaggattcctattctcttttgtgggcaagatagggtgggggacattgtgcacccccttcttctctgtcccagtctgtgacagaccctgtcagacattgagaggcctgagagctgcaacagtggttgtgccagagaggaatttgccaaagctctcagcgacctttctgcattaaagtttcgtgccattatctctttcacatacaaattcaagcccttttttttcccttgaaatcacttttgtgctgtttaacctctttaccccgatttcccccccttctttcttgctccctttctagtagtttccagctaatggatcacctggataagattgcccctgtctttgtgagagcagcaattagctctcaccctgagaaggcggcgtgttctgttgcttggcagccttggtgtagaggatggattgggtctgcgtcttttcatttgaaagtaggttatcgattagcacggatgccaatttactacagaggctgttgccaatgcctcttgatctcattatggtgtaaattttcaagattgtatcacattagctcaggagaattcaggagagaaaaacgtagtaaagttaaaaaaaaaaaagccaaaaaaaaaaattcttccattatattatagcccaggcaaaaataaacatggctacagctggccatgttcggaaaggacctgcggtgtgtgtgtggctgggttggttatgagctgtaggaaaacctagcgacaggtttcaaagtacttcatgtttttggtttattccttcgatttcttttaggactgattttcttgggaaatggtgatttttagggaaactgcagactgttgggtctatttttttatgacaagagccctctagtctcagctttgtgagacagaaaaaggaggcagggacagtgagatggcagaggaggagatgctggcgaccgtgctaatgctagctaatgctaattttgaggaccagatagtttgggtgcaggcctaactgttgttcagttaggaatctgagatcattcccttccaaaaagtggctttattgagatacaatttatgtgccataaaattcacctgttttaaacgtgtgcgggcctaactcttggccaattaggaatctgagatcattcttctataaaaaatggctttattgagacaatttatgtgccatgaaattcacttgttttaaatgtccagctcggtgcatttccatttattgccaggtctgcagccatcatcactatctaattttagaacatttctgtcactccacaaggaaatggcccattatcagtcagtcttcaccctactccactcccaggcacaggaaaagactaatctgctttccgtctctgtagattttccttttgtagcattttacatgaacaaagtcatacaatctgaggccttttgcagatggcttctttgagttggtacagtgttttcaaggctcaccctgttgtagcatgtatcagtacttcatttctctttattgcctggtaatattccactgtataaacataccacatgctgtatatccattcaccagtcgatggctatgtgggctatttctagtttttggctattatgaataatgctgttatgaacatttgtgtgtcaatttgtgtggacatatggtttcatttcttatggatagatgcctaggtgtggaattggtagttgatatggcaattctatgtttaacattttgagaaacttttttttttgaaatagagtctcactctgtcgcccaggctggagtgcagtggcgccatctcggctcactgcaacctccacctcctgggttcaagtgattctcctgccccagcctcccgagtagctgggattacaggcacgtgccaccatgcctggctaattttttgtatttttagtagagacagggtttcaccgtgttagccaggatggtcttgaacctctgaccctcgtgatccacccgcctcggcctcccaaagtactgggattataggcgtgagccaccacgcccggccccattgagaaacttccaaactcttttcccaaatggcagcaccattttatattcctcccagcaacagatgaggctttcgatgctagtatcaccctgtagctttgatttgcatttcactaatgaccgatgaggtatagcatcttttcgtgcttattgaccattcatatattttctttggaaaaaacatttattcaaccttttggtgttttttaattgggctatttttgttgttgttattgagttgtaagtctttaatatatcctggggtataagtctcttatcagatatatgattggccagtattttctcctggtctgtgagttatcttttcactttcttgatggtgttgtttgaagcacaatagttttctgtttgatgagatccagttgatcaatttttcttttattgcttttggtatctaagaagttgtctaatccaagatcatgaagatttacttccagatttttgtcttaagagtttatagttctggttccaacacttaggtctatggtccatttcgagttaagatcactcatttttcttgcataaagaaattttccagactcattcaggtttcaagaaaatagacttagaatgaccactgtggattttcttttctgtccttcattttctaacaaagcatatgtagtggccgtcacatgctgggtagaatcaagattgcaaagactgacgtaagaatttggcacatgagcaagctggagttggagatcctgacagaatctctaacacatcttctgagggtgggagaactgtcacagaagcaacctgcaggtgtgagatggactccagggccttggcactcatcagaagaaagcttgacctcctcacctgcatggggttggggaacaaagcaaattaagcatcagagaaagacctggcggtatgacacgattaagccataatggcaccagggcacagctgccaagcaggttgtcagaagggcagacagagtgatggagttttttgttggggtactgtcatatagttatttgatgaagccatctctctgtttttgactacattcttgctttcattggattttttcctacatcttgacccctaacctcctgcaacaggtatgggtgggagttgttgtttttttttttttttttttgagctttcttaagtatacctgtggttttcctccaagtcccccaaggatcagttatagctctgggaaagtggggggaagtgagatgctagacttatttttaccaaaatccaagactagtgacacaaggtagaagtcactggatggaatgaacttgtaggatattcccttttggggcactaatcacaaaggcaaattgaatggtagagtgtcaaggtgaactttaatactttgtaacatgagctccaggccaggtcttaaaacatcttggacatattgcaagaaatagctcagccctatagcacattgaatgagaatggagagtggatcctgggttggctttagactctggccttggcgtttgtgtgtacacatgtgcgtcgtcatctgtgcacacaggtacacaaatgtgtctttataatctctggggaagcaggttcacttttaatgttctttcatctgctatttgattttaaaatcttgggggaaagtattgaaaatcaaatgtactcatctgtcctgtgtaaaaataggagtcaaaattttaaaatctgaatttatgcaacaaattaaatatggagtgttacttctcatcacaaaataatctagccattgttaccttcaagagagcagtttctcattgatgcaattaaaatgaacttctcagggattcttttactataaacggaggtgcacccaaaccttatatctctgagaaaacagtggctgtgtaatgagtggtgaattgtttttggcgagtgtggctgccaggttgcttcctcctaaatctgagatggtagacagaggtttattattgctgtagcagatagagagcgtcttgcttgcactgcagaagtctgcccagagcacttaattagacatttctgtggctatttgcagcccagtacaatgggagatcaggggattccagattggaatcctagacatccaaatccatagttagcgttcagagccaaattttttattgcttctctgggattatgctaatcattcaattcaaatttattcaactcacatttttgacattctgctgtgtgctaaggtggtggaaatactttttttttttttttagacagagtcttgctctgtcgcctaggctggagtgcagtggtgcaatcttggttcactgcagcctctgccccccgggttccagcgattctcctgcctcagcctcccgggtagctgggattacaggcacccgccaccacacctggctagtttttgtatttttagtagagatggggtttcgccatgttggccaggctggtctcgaactcctgacctcaggtaatcaggtggcggagatacttaatgaaacctggttccaaccttcaagaatagcacaaggaagggaggggggtctggataaaatcgaaaggtacaagttgtgttgggactaagtggatctaaacatgctttctgaggctgtcattaccccaaaagtcagctttgtgtcaatcaacaaacactgtggtctgtcttttctctcagcaaagtctgaaggagtgggacactccaactgtgtgtcacaggaatgagctgtcatctggcaatttacagaccagcttcaaggattccatttaccaccagtttattcacttgtatttctaatatttatattttcttaagatgatcccctctcccatgtgtgctaattttctaaataacagccacatcgacaaaatgccccctttgatgagtcatgggctgagctgggttctagtgatgctggctacaaccttgagagttaaagaaaagctatttatattttctttttattattttattttattttattttattttgagacagagtctcactctgtcgcccaagctggagtgcggtggcgtgatctcagctcactgcaacctccgcctcccggattcaagcaattctcctgcctcagcctcctgagtagctgggattacaggtgcccgccaccacgtccagctaatttttgtatttttagtagagacggggtttcaccatgttggtcaggctggtctcgaaccccttacctcgtgatccacccaccttggtctcccaaagtgctgggattacaggcgtgggccactgcgcctggccctatattttcttaagatggtcccttctcccacgtgcgctaattttccaaataacagccacatcaacagaatgcccccttcgatgagtcatgggccgagctgggttctagtgatgccggctacagcctcgacagttaaggaaaagccactttcgcaaagaatggaccctgcttccgtaaccttgggttaaatgttgtctgcgagcaccttactgagtttcttcattttttgctttatttgggtgcagctaaaccagctaaacagccttaataagttactccctgggatacaataagctccctgcatctgtgaggtgaaaggcagcccagtgaattctgtcgacagtagctgttctgagaaagtgagcttgaaagggggtgtaggagtcaaaggtgagaggtcatgacgtcagtagtccaaacacctggaggttttagtctaacttcctttcttgttacttagccaggcagtaagttacgtatctctaacttggccttctgtaaagtgggactcttagtacttgccctgcttatctttcagacagaatcaaatgaaatagcagaagtgttttgtcaattaaagtgacatcagatgcaaagagtattattatatcatcatcatcatcatcaccaaaggaactatggtaatgttggataaaaagccaaatacttttttttttctttctttctttctttttttttctgagacagagtctctctctgtagcccaggctggagtgcaatggcgcgatcttggctcactgcaacttccacctcctggattcaagtgattctcctgcctcagcttccagagtagctgggactacaggcgcgcaccaccacgctcagctaatttttgtatttttagtagagacagggtttcaccatgttggccaggatggtctcgatctcttgacctcatgatctgtccgccttggactcccaaagtgccgggattacaggtgtgagccactgcactcagccaagccaggtacttttctaagtaatttaattctctagaagaaaagatgataagatctttgcctggaactggaggccattatcttaagtggaacaagtcagacacaaaaagacaaatactgcgtgttctcacttataagtgggagctaaataatgtgtacacatggacaatagagaaagacagacagtggagattgcaaagatggggcaggttgatgaggaatgagaaattactgaatggacaccatgtagtttattccagtgatggatgcattcaaagctcagacttcaccaatatggaatatgtccatgtaacaaaattacacttggaccccatacatttatacaaaaaaagacctttgacactaggcataactagtggtttggttaatgcagaggagtattgctgtggtcgctttcttttaaccagcttgagagacagtacaagagaaggttcaggttcttgtcttgacagaagtctcagtacacccacctgtactttaggagaatgtggattggaaggctcttggtgtttcagttttctgagtgggtttgagtaattatgttggagagggggaggttgatgagagtgtaacacacttttcgtggctataagagatgataataaagagttattagaacatttattagacacatgatagggaaagttggttaagggccttgaagaacaggcaaaggatgtggaattcatgtttttgagctctagatgatatgatgaaaattgtggttgaggattatttttctgatcttgaggaaattcaagtttgaatgatgaggatgaatgaggttaatcaacactgaaattggaatcagaggcaaattcaaggccgggcgcggtggctcatgcctgtaatcccagcactttgggaggccgaggtgggcgaatcacctgaggtcaggaattcgagacctgcttagccgacatggcaaaaccccatctctactaaaaatacaaaaattagccaggtgtggtggcacacgcttgtaatcccagctacttgggaggctaaggcaggagaatcacttgatcccaggaggtggaggttgcagtgagcctggatcgcaccattgcactccagtctgggcaagaagagtgaaactccatctccaaaaaaaaaaaaaaaaaaaaagaggcaaattcaagacacagtagaacaggggtgtggtcggtgaagccgggagagtaggcaggaagtgaggccagtttgggaaccagcaaagcccacctctctctcgaatagcccctatttgtcccaagatcttactttcctaccatcatgtttggttttgactgaatagctcaattcagagagacatttcaactttccctctgtgctttgcaaactgatgacgaagatatgttttaaggaactagctcccaagttagttcctcttacaaagatgtacagattttaaaactgaacatgtgtgtgttgctgctgagaatgtaaaatcatgcagctgctttggaaaatgatacgacagtttttcaaaaaattaaacaaggaattacatatgattcagcagttccacttctggtataaacccagttgaattgaaagcagggactcaaacaaatatctgtacacccatgttcgtagcaacattattcacagtagccaaaaggtgggaacagcccagtgtccatcatggatggatgagcaaaatgtggtctatgtatttacaatggaatattgttcagaaaaggagtgaaattctgaaacaggctacaacatggatgaaccttggagacatgatgccaagtgaaataagccagtcacaaaggacaaatgttgtatggctttgcttacacgaggtacataaagtaatcagactcagacaggaagtagaatggtggttgtcaggggctggagttgaggggaatggagagttattgtttaacatacagagtttcaattcgggaagatgaaaaagttctggagatgatggtggtgatggttgcgtagcaatgtgaacgtactgaatgccactgcacacttgaaagtggctaatatagtcaagtttacatgtattttaccataataaaaatggtgaactgtcattatcttgcattgttgatgcttttgttcaaatcctgggaaatatgatataataaatctcttcttatgttattccaggtctggaaagtgaactctggttaacttttcaatatcattttccccaggaaaacaaaagataatgatgtttcctaggccaaacacaccttgttaacatttccataacaaaacagcaaactgtcatttaaagtttatctcactgttattcttgagccacaaagaagcaatgtttacagacgattttacactaacaattggatgtgctggaaatgggtatttgggtgatctcagggttcgtgaacctcaggctgtggagtgttcttgttctagatgtccgctgagagttttctttctcaaggggctcctaaattagaggtaagccccctaccacctgtgtgatcccccagaagttagaaccttgcgccttctctgtggcagggaggagacctgtcctctctagagctggaaggttgtgtgttaacaaagttgaaggcagtcatattagtctgttttcactttgctgataaagacacacatgagactgggtaatttataaagacaaagaggtttaatggactcacagttccatgtggctggggaggcctcacaatcatggtggaaggtgaaagtcacgtcttacatggtggcagacaagagagaaagagagtgaagtgaaagaggagaactcctatgagaccatcagatctcgtgagacttactcactaccgtgagaacagtatggggggaaaccacccccgtgattcaattatctcctccccggtccctcccacaacacgtgggaattatgggagctacaattcaagatgaaattaacctatgaaaccatcagatctcgtgagacttactaccatgagaacagtatggggaaactgcccccatgattcagtcatctccccctgggtccctcccacagcatgtgggaattaagggagctacaattcacgatgaaatttgggaggggacacagccagaccatatcagcagcctatgggatgttcccccgagggctccacagccgggtgctcagattgctgggactctcttgtcaggacttcttccttcttttttgcctaggtcttatcagaactaagccatttggtttgtaatctttcctgtaacactggctgcagggtctttagcctggattctagattggagggtacagggcagcagcctcacaggtgcccattagcacatcccacaagcagtcacggcactgcacttgcactggaaacagcttctcattttcccgggagtaccttctgccaactttgagaacaccaattcctaattcctgttccagtatccactttggttttatacataggacatcttttcctataagttttccctgaatgttttgttttgtttttttttttttttacatttcttacagatgtctattaaaatctcagcattcttataaaatactctttgatttgaagaaagtagtcattttcccttaggcttatgatgcctcagtctccctataagagataagaaccaggctgggcgtggtggctcatgcctataatcccagcactttgggaagccaaggtgggtggatcacctgaggtcaggagttcgagaccagcctgaccaagatggtgaaacaccatctctactaaaaatacaaaaattagccggtgtggtggcaggtgcctgtagtcccagctactcgggaggctgaggctggagaatcgcttgaacctgggaggcggaggttgcaatgagccaagatcgtgccactgcactctagcctgggtgacaagagcaagactctgtctcaaaaaaaaaaaaaaaaaaaaaaaaaaaagagataagaaccagatatgcataaatatgaatatttgttcatttgtaatctggctcttcctgtgataagatgccaccaatatttgggtagaatgctggggagaagttacctcccaacattgaaaagagtaaaatcccagcactttgggaggccgaggcgggcggattacctgaggtcaggagttcgagaccagcctggccaacatggtgaaaccccatctctactaaaaatccaaaacttagctgggcgtgatggcagacgcctgtaatcccagctactcgggaggctgaggcaggagaatcatttaaacccaggagacagagggtgcagtgagccgagatcacaccactacacacccacctgggcaataagagtgaaactcttgtctcaaaacaagcaaacaaaaaggattaaatatatataaaaaaatctagaaggaaatatatggataaagaagtttctaagcttgatagaatagaaggtatcacaagagaaaatatagacaggtttgactacataaaaattaaactctgtatatcagaaaacatttgtacgttgacaaaatcaaagggcaggcgacaatctgcagagaatgtaaaaaattacaacgaagcatgaatatctttaatatagaatttttaatacaaattgctaatgtcaacattaagaccgcagtagtttaagggacaaaggcagttgaactgactttgcaaaaggggaaacaaacacacatggctaccaaacgcaagaaaaattgttcaacttcattagtaatcaaataaatgcaaatcgaaacaacagtaagctaccatttttgatgcagcttaacaaagattttgtaaaatgtgatattctttcatataatgaaggataaattaataccattttggaaagcagtgtgatgaaccttaaaattattcttactccttgacctggtagttctatttctgggaatctatcttaaggggataatcctaactaccaggattaatgcacaaaagtatttcctgaagcatttaaaaaaaataattataaagaattagaaagaagctgcatgttcagcattagggaaatggttacagaaattatgatcaatctatttgatcaaatgctgtgtggtctcttaaaataacatttgtaaaatgtttcccatgtttcaggggacgtgctcatgatataattaatgctaagtgataaaaaagcaggatataacctcaaatgtaagtattttctggtctagacagtttaaaacttcacaggaaagaaaaaaaaggatgcttgctacaatattagcagagaataatattgatggctgctggtctcccctagtaaactgtgtttcctaaaagggcatacattactttaaaaacatttttaattttgagatattttgtaaaaatttgattctcatatatctgtcttaagaatttattatataaatcatccttgaataaactaagttacatagttttcaaactctgtctcctgctaaatgatcatctatactgatgactttttaaaataatataaacttccaggagggaggaaagaggtatgtttattttaggggcctccagagcccacagtaactcttccttcttggggagaggagtctaaagataacaggcctgagtttgtgaactctcatctctagtatacttgacttcttctatgtatttattgattgtgtggtatcacagatttggggggtgcgtgtgcaggtgcacgtgtcccgttctgtagtggtggggattgggtttctagtgtacccatcacctcaatagtgaacattacacccaacagataatttttttttacttttagtctcagggcactgtgcaggtttgtgatacaggtaagttgtgtgtcatgggatttgctgtacagatgatttcatcacctaggtagtaagcatagtacccaataggtagtttttgagactcacccttctcttaccctccaccctcaaagtaggtcttggtgtctgttgttcccctcctagtatccatgtgtgctcattgtttagctcccacttataattgagaacacacggtatttggttttctgttcctgtgttagtttgcttaggatgatggcctccagccccatccatgttgctgcaaaagacatgatcttggctgcatagtgttccatggtgtatatgagccacattttctttatccagtctactgttgattggcatctagcttgattccatgtttgcactattgtgaatagtgctgcagtgaacatacgtgtgcatatgcctttatggtagaatgatttatgttcctttggtacttgacttcttattgccattgtgttcaccaaagacaatcatatgactcagtctgtttcaattggtttgaaagcttaggctttcctttttaaataaaccggaaagcttaggctttcctttttaaataaccttttttcaaaatttcatatttttttctcattttaggaatgtaataatagtcatcatgcgttaagagctttcaaagaaccagatcctgttctaaacactttatatgtgttacatcatttaatgttcacagcaatcctctgagatgtaggtactgttatcatcccagttttacagatgagaaaactgaagcacagagaagtcaagtaagtggagaagcccatgttcaaacctgagtcatctgtcgccagagcgtccctccactgcgccagatttatgacaacttacttgttctttatgaaggcagcaactcaggcacagtaggccaaggctgccatctgatgaaacaactggcaaatcaatggcagagaaagattcagagcagagacagggctgcgtccattgatcgtgttaggacctggaccatggggcgctagaaaatgacatggacgccagaaagtttctttttgctgctgactgatcatttatgaactttccatggacttttgaaaataatatcaaaataataccactagaattgttaaagcattccacgtaggacactgggtcatttgatttctgtaggaaaatgtgattttgtaggaaggcgtatggtagtttcttccatataaggccattatctcgtctttgaacctaatttctactgcagttcaggtttggagaggcctaattcatcgtggtggcacagttttaaaatttgcccctcatttggaattgatttagagtttccgtttacatagagtgcttgatgcaggaggcagttatggaaagggaggccctctctgagcacggtgcatggggttagagttgcctagattttggtaacatagtgacactgcaaacaaaactctatggaaacaaaataattttttttttctttttggacacagagtcttcctcatgcagcggtgcaaactcggctcactgcaaccccttgggttcaagcgattgtcctgcctcaggcccccaagtagctgggactacaggcatgtgccaccatgcctggctagttttttgtatttttagtagagatggggttttgccatgttgcccaggctggtctcgaacatctgacctcaggccatccacccaccttggcctcccaaagtgctgggattacaggtgcgagccactgcacctggcctggtttttactttcaaatctgatattttagcctgttagtgttaaccatgtttaactgactcaaatgaaatgctggccctggctcccatatagccagaagaataagaatgctggtaatcaggtattggcgtttcttcaaaaagccaaaatctgttgtaatagaaatactggtaatttcttcactctgtgaagtacatgtgtatgggggtgtgtgtgtgtaggagagggttgaagattttaacagttgtttgcccaaggttactatataatctaaacatatataaggctccaaggcatttagcttatggggaaaattaaatagtggctattttataaaggcaactagttgggaggcctcaatcattgttactttttatgggctctactaggattttatgtaggaaccagtgtgatctggggaggagggattcctttacacacatccttcagaaagccaccattgtattcctgttgcatttgatgaatatccctagtaggtttcttttctccacctgccacctaggtagatcaccactgctgcatgtcacttttactgaagtgagtaaaatctctgctagtagtgttttccaattatgcatatattttcttagtgcttatttggcactgactttggggagtcgtagtctttctgagatgggaataacatcatttgtttgttgcgcctcagttccaccgtcatttaaataggaggcgtgtcgtgatggtgggcaaccttgttcccacctgaccttgtgagatgcgctaggtggattatggtctttgaactacacattgcttgaattccttgggagacgtgggtcacataaacaggagcctgtgatttttcaggattgacggggaggggcatcttcctttcctaaatccttcctttgatctcctcagcggaggtcacttaagcaacagctggctcttctttgcccctggggctccgcttcagggccgggggaaggaggctgagcatgtcgagtgccctgggaaggcccatctgcctgtcaggtgttgtttttccgccaaacaccgaaagagctatgttttgttcctcttaaagagtttaccatccagaagggaaaaataagatagaaagtaaatagctacagcacacagtacctctgaggataggggtaataggattgtggtcaaagcagggtgtgctcggaaccatttgaggcgaccggcaatcatttccttaaaagagtagccttgagaaaagctctaatagatgggtaagattttgatgggattttggtaggagccaaggagagtaatcaaagtggaaaaaggagggactggagcccttgcctggggcttgaggttatcctcgaggtccttcaggatgtccttctgtggcaggaggatgatagaactatttgtttctagtgttttgtatggttttagagccttatatattatggtgacagatccaaggacacaatgatttgatggtgtccctgtaggaagaccccgtttaacaagaccactattttcctggtaaatgagatataagatgtatagtcttttgtttcctcccagcagctactctgtggatacatcctgtgaacttccctttgcaatgattaggatgacagcccctgtctctaagcttctacctgggctccctaagtccattttcttcccattcctaatagctctgaaaacaaccttccactgtgtttcctccagcatatttccgagttgattgtcaagcacagctcttatgatatcactgatctgctcaaagcccttccctggctctcctgttgaatggtgacctgggtgtaaatgcctcagacctctcggtctcctcccacctttccaagccatatccccttcattgactgtgctccaggcaccacctccagagtagacctggggtgggcctcagaactcgcatttctaacgggtttccaggtgatttccgagaaccactgccatagccaagccagacaggtgtggcttaacggacctcagaattctcccttggatatttttttaagtgcatcttccttcactttgattactctccttggctcctaccaaaatcccatcaaaatcttacccatctattagagcttttctcaaggctactcttttaaggaaatgattgccggtcacctcaaatggttccgagcataccctgctttgaccacggtcctattacccctatcctcagaggtactgtgtgctgtagctatttattttctatcttatttttcccttctggatggtaaactctttaagaggaacaaaatatagctccttcggtgtttggcggaagaacaattttgagataagaaatcctactcctcattgattctgttccgcatttggagatgttggcaagtgcgtcgagccactcagagggcacggattagattttattcatattagaatcctctgcatcacccgaccaattatttgcccacagtaggcccatcataaatatttggtgattgaataacaaccttccacactcaagatgttgcaggcctgagaagtaagaagaaagcgctgcatagtcttcctgcttctattcttgtaatcctcttataaaccatgggccttctaggagaacaattattatttttaatgaactggtgtgtggcatagcttaaacctctttattatccttcagcacttagctttgaataggattaatcagccaggaagatctgaggaggggcagggcaggcttcgttcccaggttattgcttttccagtgaaaagcactttgaagaggacagtggagactgatcttttattttaattcaatataattataactttgttttttttacacacatcacacacacacgtgctcacacacttcagaagtctcatggctaacgatggggctgtgtaagttattcattaggaagatttgagaagcagggtcaagcaatggagaaaaggtatatatttttgaggatttatttttagtatttgatataaaaatgtatgagtaatacatgctgattataaagaatgaaaataggacagaagaagatagagtcaaaagttaaagtgcccccggggaagtgtatttatataaagtgacacaggagatattttgaaattttaatgcccaaaagtaaagtaaatgatgttcaccatatagacgacaactaggcacagtttcaccacccaggataattaatgtgtgatttttctggtgtcctcaaaattattagcactcccatgcgtactggagtttcacagatggatttcactttcacatttgagcatttctcagtggtttccagcctcagctctctcttaagcagatgactttagccaagctgagggcagaaaaagctaaggaatgagatcctgtcttgtctcttcctcccctgctccctcccttcctcctaccacccacacatccttcccttttgcagcagatactcgttgagggcttactatgctgcctcactgaggcattgtgccaggtgtcaggaatacagtggtgagcaaaacagacctccagtacttgtgttttgggagattcaaatcaggataccagagtccatgcagtctctggagcagacagcctgagttcaaattccagatcagtacttactatgctatgtgccctcagacaagttacttgtgtctctggcctcaatttcctcatctgtaaaatgggaatgataaaagcatctacctcaaagttatttaatatagggattaaaataaataaagatgtaaagtgattaaaacagagtgtaatatttggtaagtgcttggctgggtgcggtggctcacgcctgtaatcccagcactttggggggccaaggtgggaggatcacctgaggtcaggagtgcaagaccagcctggccaacatggcaaaaccccgtctctactaaaactacaaaaattagctgggcatggtggtgggggcctgtaattccggctagttgggaggctgaggcaggagaatcgcttgaacttgggaggcggaggttgcgtgagtcgagatcgaggtcgcaccattgcactttagcctgggcaatagagagagactccgtctcaaaaaaaaaaaaaaattgtgagtgctcagtaaatgttgttatttacagtcagggtgtgggcagacatttaacaaataataataaataactaggaagttctaactgagataaaggaaagatgatgctctggagagtgtaacgggggttctaatgtagaccggggggtcaggaaggcgtggtgtgcagctggtggtggaaaggaagcccctgcggcagcgtcgggggaggcgggagagtgtggccgctgagctgagctgagctgaggctggagtcccaagcaggggacagactaggtggggcctcagggcatctaagttcacttcattcattttacagatgaagaaactaaggtccagaaagataattgctttgtccagatcacaggctggtgacagagctaaggcaagacgcaggtctccttactcctggtgcactggtgaggaaaccttttaacctcaaactttcatcattttctgtctctatcagatgcaaatctaaatgtccttacacttgttcctggtagggtgccctcgtaccaacagagggcaaatacacgcaagtgtgcacatatatactcccctccctcctccctccctcctcccttcttgagggtggtggtgctcagggtgtatgttggatggtagtgcgtagttgattaggggagaattcaggttgcttctttgtttccagttttaaataatctgacccatgtgtctctttattcatccatcatacctgttcatatatccacatatctttggtttttttttttttgagatggcctctctgttgcccaggctggagtgcagtggtgtaatcttggctcactgcaacctccgcctcccaggttcaagtgattcttctgcctcagcctcccaagcagctgtgattacaggcatgcgccaccatgcccggccaattcctttggtatgtttaaatagagatggggtttcaccatgttggccaggcttggtcgcaaactcctggccttaagaaatctgtctgcttcagcctcccaaagtgctgggattacaggagtgagccactgtgcctggcccatgtatccacatatctactcatccatctgtccatccatccatccatccatccatccatccacccatccacttgttcattgatttattcatgcaatccacaaatatttattgaagggcagatatgtgtcacaaatttgtgttaggtatttttgatggtcagccaaacaaacccggcctctgccctcatgcagtttacagtctgtcagcagcaaatcgaaaggaacatatcctgtgtctacacttccgtgctatcattgtgcgatgggattttaaaaaattcacgagattgttctaacacccacaaggaatgcacactctcgttaatcccacacgactatttctttagtggcttatttgtgtttaatttccaagataggggcggtgatattcccaaatcccatttctctcctaaatctcgttttcacagatgctcagcaaaggatgtagggcgactactgcagcagcacacagcattcaaccaggagtggaatttcatgaactgctctttatttcccttctggtctcttgagtctggttcatcttgtctagagctctgataatctccgagacaaaatatttaaatcttctgcagctctagggactttgaggaaggaatattgtggctaaaatcctaaatattttggaatatcattaatgcaagggttatacagcagatgctgtctggcacaatctccatcccaagagaatgtgtcaatatctttgtatatggaaatgtacatgtatactcataaatttctccagcctcccaattctgtatctctttcccctttgagactgacttttacttcccttctttagcccctgcttactttaatatacattttttctctctgttttcagaaaggggtaaaaaattgttaccataaatgattgatagaggcctgaatttttattgttatctcttccggagtggaaacctgccttttcatagagaacgcagctttaatccaaaggatggactatctaattgttgaatttcaaatataggcagggctgattgagggtatagggtttttcaaacgttcttaaaatcacaatgtatgagtaaaggcataatactgatgggaccacagtacaggacgttttccaaagggcgtgaaagtcattgtgtgacccctgttgatgcctctttattcttgttttgtagaaaaagtaactgatttcttaaaaagcatattaagcccacaccctgtgcccagtatttctttagaacaaccctaaaaaggagacaggattatcttcactttacacccaagacagctgaagacgacagcagctaagaggcttgctcaaggccacacagttaagaattagagttgagcctcagagctggctcttgggtctggaccacctccctgggttaaatacagtcctgtctcagtacacacactgcctcgcctcctgatttttaaggtattacaagttaaacacgcaacaaatagtctagatcagtttcattttgaaataacatagcagttataatgtggatgatattatgcttgaaataaaataatcctgatcatggagcaagcacagtgacctgccttaacagttagatgttagtagagaggacacagagatcatttaaatgctagtaagggcttgtgactgcgttctgaatgcttagtatttttagattcctccaatcgcttctaaccttcagccctgccatggttttttctgtgaccactggaattctaaattcagaaaggttgttagccacctggataattgcacctttgtaacttttaagacaacaacctagaggcagaggataactacaataaatgacttgtaatttcaggtcttagatctctgctttcacataaaaccagctttccacttccttaggttcaccacctgaagaaatcaaagctaagcattaccagaagtcattatctactatttaaagcctgttctaagcgggagacaagccccctttttaggaggcgtgggggcggggggaaggggatccatttctcattttgccatgtttctgcaggaatgtttttaatagggatcctttttacccccagctactctgcagcacaggagtacgactgtatttgaggaggcagcttgacttcatgctccagggagaagtcttttatttcctgttggggttttaaagttgcccttgcttaggtcgttgctgttttataagtcagcctgaatatttaaaggcaggaggcctgttggtctatgttatgttggccttggggcattagaatgacagagcagctttatttaggattgcgaggcaggccatatgtactcaattatcccattttcgaggacttggccatttgtaccacatctccctgcaagccctttcatgagagccactattattattcacattcagtaagacctgagaaatattattagccaggaaagctctcatttacctcgccatctctcgcaacgttactcactgccctcactgcagagcactccttgtgtaccctctaccttaactaagtttgtcccaagaaaatgatgagaaattcttttacgctggcatacacagactaatcaggtttagtgggaagagcgtggcctctcaagtgtggcagatctaggttcacatcctgatctaccggtctgagcttggaaaacattacttcatttttctgaacctcagtttctctgtttgaaaatgggttgaagtggccgggcgcagtggctcacgcctataatcccagcactttggggggccaaggcgggaggattctttgaggccaggagttcgagaccaacctggccaacatggtgaaaccgcgtctttactaaaaatacaaaaaattagccggacgtggtggcgggcgcctgtagtcccagctactcaggaggctgaggcaggagaatgccgtgaacccgggaggcggagcttgcagtgagctgagatcgcgctgctgcactccagcctgggtgacagagcgagactccatctcaaaaaaaaaaaaaaaaaaaaatacacacaaaaacagccgggcatggtggcgcatacctataaccccagctactcaggaggctgaggcatgagaatcacttgcacccaggaggcagaggttgcagtgagccgagatcccactactgcactccagcctgggtgactagagcaagactctgtctcaaaaaaaacaaaacaaaacaaaaacaaaaaaggccgggcgcggtggctcatgcctgtaatcccagcactttgggaggccgaggagggtggatcatgaggtcaggagtttgagaccagcctggacaacatttttagtctctactaaaaatacaaaaattagccaggcatggtggtgtgcgcctatagtcccatctacttgggaggctgaggcaggagaatagcttgaacctgggaggcagaggtttcagtgagccgagactgtgtcattgcactccagcctgggtgacagagcgcgactctgtctcaaaaaaaaaaaaagaaaatgagttaaagttacaaggaagctgattttggcatccataagaaaaatgggcacaacgatcgttgctttttgcgtggattgccacaagaatgtttttggattcacagatgtttaatactacacatcactttctccttctcctacttttcccataggttttcattcaacagatatctgttgattatcttgtggtgtttcaagatgtgtccatctgcattttagctgggcatatgcccaaacagcatagatttcaagctgtcacaacccaccatgggacagatacttcttaaagtgtgtgtgggttgcgttactgggacccccaattgccacaccgctagcatttgtccacttgtaaagattttcttacttgtcttccttgttgaatcaggaagtggacttttacatggtgcatgcagtttttgatgcgcttcctctccctgctccctggaggtgccgcatgaaagcgcttttccctggacgttcagttccctctccactccttgtctctgtgcatcctgcatcttggcatctccccccgtgacatttattcctgtgaatctgaaaacttcctgtatgttttgtggctacattcgtattccagttgctagagcagaggggagcgggtgctgccacgtgaactttggtgttgaaagagcttcaggataaagttttcagaggacctgctatcaaccaaagctacttgaatataattaggaactaggtccagttcctaatcatactccagaggaggataaatccataggctgtccccaagccagttagctctgagtcagcaatgagcttacatcttcacacgcagatgctgtaggtttacttcatatgtccttctgcagtcattgtcctgcacggctcaggtggcagtgacatactggctagggacatggagaggagctctcacaagggatctggaaggtacatcaggcctaggagagaggaacaaatgaaaacggcactggggcttcatggatggtaataattcatacaggagactttccagttagagcactaagtatcaacactatttggagcatcactccaaactgtactcatttcaaactataatgaaatgcgtcttctctgttgtaagatctctctttttttttttttgagatggagtcttgctctgccacccaggctggcatgcagtggtgcgatctcggctcaccgcaacatccatctcccaggttcaagcaattctcctaccttagcctcctgagtagctgggattacaagcgcccgccaccatgcccagctaatttttgtatttttagtagaggcggggtttcgccatgttggccaggctggtctcgagctcctgacctcaggtgatccacctgccttggcctcctaaagtgctgggattacaggcgtgagccaccacgcctggctgttgtaaggatctcttaaatttctcttatggcttcgtctcaaccacagagcaaataatccccttaaaaatcttaagtttttagtttttccagggctttattttgtgtgattttttttttctttaagagatgaggtctcactctgtcacgcaggctggagtgcggtggcagaatcatagctcactgcagcgtcgaactcctcagctcaagtgatcctcccacctcagcctcccaagtagctgggacctcagatgcacaccaccattcctggctaatttttaacaatttctttttgtagaaatggagtcttgctatgttgcccaggctggtcttgaactcctgcctttgagtgatcttgctgccttggactcccaaagtgttgggatgactggagagagccactgtgctgggccttgtttcttaattgttcatttaacaggcctggttggggtgtgaaatggagtccatgtgtgtattttgcatcctctgtaaatatggccgtagagtacattctaaacacagcctttctgatccactggcttttgtgcataccagggtatgacatcgtgttaaaaagaccgttagtgtagtgtattgtttttgtaaatgcagtttattctaagcacactatatgctggaattatttctagagttcatagtggtattatcattaaggtgtatggaaagtatactaattcctattctataggcaaaaacaactggagcacagcaatactactgccttattgaatcttataagaatatagggggaataatacttgaagtgtacaataataataataatatgctcaaccagcaacactaattaccataagaaagatgtggttgagaactacatttccacaataattacacaattgctacactcacttggcaaccttatggtatggctggtatgctagcaaccaaatcttcctgtgtaaaactacttccatgatgttcctgccacaggatttcgtgctgggctgacagaacagaacagtttcctgaggaacgttttctttttctttcttttcttttctttttttttttttttagacatagggtctcgttctgttgcctaggctggagtgcagtggcaggattatggctcactgaacaccttctgggctcaagtgaccctcctgactcagcactctcccccacccccacccacacccccacccccaccaagtagctgggactacaggtgcccacatctggctaatttaaaaaacttttttttaaagagatggggtcttgttatgttgcccagggtggtctggaactcctggcctcaagcaatcctcccacctcaccctcccaaagtgcaggaattataggagtgagtcactgagcccagcccccaaggagacttttctgattgctggtctttgccatcctcagagaaccaggcggggcacccagggtccctctttgttgactcataccttgggttctcttatatttactcaaacataatgtcctgaagttatcagtagtcccttcttattctccagctccctgtaaaggcttaaagcataactctgggaaaatgttttgcttgggtgggcagaaatggtatatttgggtacagatgtgggatgtgaagcctcagctgtcactgcacctgcacccagagtggtccccacttcttccactctttgcatctgtcctgggcaccctcctttatctttgcacaaaggattaagcatttcatgtgatatgccttaaattgattttccttatgagtagggaaagggagtggggatagaagacaattgtttaatccaataatcatgcaagaatgtgttcttgacattaagagaacaactgtagtctgtggagtagcctaagacacagttgcacatagctatgcaggcagttattgatctgaagaatgaaccgtcatggctgctttgaggaataagatgcatcactattgaaggaggccgggagaatactggagagtggtctccaaccctggatcttgatgctgctgtttactgcagccatgcaaaggaatgtgtgcttcaggtctgagtgttcaaggcaggaccagcaaatttccatgaactctctgaccgtaggccacctctgttccattttgcttctttgctcctaaaaaaattaaatatcttaagttagtttataaaacattatactttaaacaggaagtgaaaatgtttttctgtttttaaaagtaatatatgccattgtagagaatgtggaaaatacagaaagattcagagatcacagaattaagaatccaaatgattttgaccagctggaatgatcaagtctgaattagcatgatgatatttaaatgggatgtgttttgctttgacgatttcggcttagggtcctcggagagagaagcctgtgtcccttaagcctagcaaggtacttggcagagaagggcagagtggggcattcctgaatgaacaaatggatgaataaatagaataggatgcatggaattaaggcaggactccctgtgttggaagcaaagctaggagtcacaaggagaacgagcactcaaaaaagagatttctcagcaaggcaaatttacttctgcagaagggtgcttctcacaggactggttgccacgagagcacaccgaacacaggagggaaagggtttttttcattcctaacgcagcttgtccttactgctgtgtcctgcctccattggctggagttggaccgcacaatctaaactgaacccgattggctaacttgaaagacaactttggcgggaagagctgccacagcaggaggggtaaattacagagtgagtagcagacgtgggctctgtagataaggacttacaagggacttacagtccggtgaagaactaaacagcaatggcatctaataaatacccaaggatgagcagttggtttcatcttcatactccctaaggaccggtgggagagttgtttactggacccggaagaaacatgatagaatttctggggcattcactttggaggaaaccatgggatggtctacattgaaggcctgaggaacttttccctcctccgtgctaagttggtagtttccactttccaccacccacttcccacagctccccccaaacacacgtacacatcgtttttcacaccatcatcctttttggtaaagagatgtgtccatttctgtcctgcattagtgagttccttaccaggtgcaaacactgttagatgtcctgaaaaatgtatctcataaaagagctgtagcaggagggagtatcagagaagagagtagctttccttttgctgtctggctgcaaaaccatctggaagcccccgcggaggtgggctgtgtgcccgagccctaccttggagagacacttggttcccttttccagcagatttcttttcctgacagataattctctgttaatcgagggctcctcaaatccgaatctgagcttcctcttctattctcacctctgtgccagggaaattttcttggcaattgaaaccaaagcgataggctggcagtgggactctacttggctgggggtaaaataagcaatgattgcacataattgcagaaaacaattttgaattttattaatgaggtgctccaaacaacatcttttagtccattgtcccacttaacagccaattcaccggagttcattgtgctgtaatttacatctatcttcccccattgataacaccaggcccttgtgttctgtaattgacacaagttggtcattttcaggggtgtttctctctctaaggacataaaataaacaggcttgctggcgagtgggattgagttagcctcatccacagagccaattggctgctgctgcttgacgctcattttccttcctcaggagaggtggcacagccgtgggtacgtgcacagaaagtcctcaggttaaagatgttgaggtggaggcctggggaggcaagcggatgtcgatagtgagaaaacgagacttctttgcctttcctttgcttcttgccacccaggacccaacatctccaggtggagctgatttttagtgtgcgcagccaggctttgggggcagtagaggtaagattcaggggagggtttccaggaggggatataggccaccacctccttcagcatctcatctcaaaatgtagcatgtgtgagtcgccactataggtcccagtgagctcagctagcccagctcctaccttctttgtgtgtttacagcaaaaacgctgtcactgctttcatgtgtctgtttaaacactgtgtggccatcggctctgtgttgggcacttagggagtatgaagatgaaaccaactgctcatccttgggtatttattagatgccattgctatttagttcttcgccagactgtaagtcccttgaggtcaaggatctcgtctcctctgttcttagtatcctctatagaaccgataacagagtggacacttagaaaaacattaacaggccaggcgcagtggctcacgcttgtaatcccagcacttttggaggctgagacgggtggatcatctgaggtcaggagtttgagaccagcctggctaacatggtgaaaccccatttctactaaaaatacaaaaaattagttgggcatggtggtgtacacctataatcccagctactcaggaggctgaggcaggagaatcgcttgaacccgggaggcggaggttgcagtgagctgagatcatgccactgcactccagcctggctgacagagtgagactacatctaaaaaaaataaaacaagaaaaaaaataaaaaaagaaaacattaacaaatggatgaatcaaatggagaagaagagacaagtacagaaacacgtgtagaagtggaaaagaaaaaacaaaaacataaagggagctctaaaaggttacagaaagagctgtgggacatagagagaggtgtttcttttccctggggtgagccgggaagccttcatggaaaggctggcctggagcatgagagattctcatcggtggacggtggaggttgagcatttcaggggtaaattccgagaacattgtacacacataagaaataatgcaaggtgcctatggctttgacttgagcatttggtatgtgcaaggaagtgactggagatcaaaagggaaatgcagattggaaacagggcctgggggtcttgtggcagcttgtgggtggccatgctttccctgggcactgcccgacccaggggactcagctgcgggtggcacgctcggcgtgcaaggcatttgcttactggaaactacacccgtaagaagatactggggtcttgggaaggaaggtgactgttaacctgtgggggtcagcttacagtgtgagtgttggccagaatgatcaagctctccagccttagcccagatcaaaatccagaggccaggaaggatgtaagcctagctctgtgccatgcagctggttggaacagaggtgcagatacaggctccacccctctgggaccatcagctcccagggtgtctgcagcctcacagcatgactctctcccagtcagcccacccccaaggccccgcagctgcagcttctgctgtgctttcattccagggatgggcagggtgacatcaggccacccgcagcctctggcctcagcctctctgcctaggtggcaccatgggctccaaccagccggggcagctgctgggaccaccccgcacaggcccactctgcagtgagggaaggaccgacaggcttgcggctgctggattactcagtatttttcactttaatatcctaatcctgaagttgttctgcgatgtggtgttctggtggtaaatataatcttttggcagagtttttgaactgtctggaacccaatatcctaagctttttttttttttttttactgtatttggattatattgtgggatttttttccccaaggaggaaaaaacgtattttaaaatacaacatgaagtgagtgaaaaaatttgtttaatgcaaataaaagaattgaagctggagggtgagtgtttccagaggaggccatcaccgtaggaggagaagctggactcagagccagggagtcccagagcctgtggtaggccctgtccttgtgtggggagatcagccagttccaagtgcagggaccaaggacattcccaagcccgtcctcagccagctagtcctgcagggctgttcggagcatccaggtcttctgtcattttttcttccccagacaaacctcctagacataggaagccctttcagaagacacatttgcctctccacagctccacccattatcctttaccactggcgatgttctgttcttcttgggacaccacagcgttatttgtctttccagaccaaaaatatatccctcaggagtatggcggtttttaagctcacaccaagggaatgcttgtataggccttgtgtcttcttgtgatgtttcccagcgatgggcctgaacgggagagactagccaactgttgctgaacgcgatattcttttgtgaataaaaaggccctgattccagccaaaccgggatctggtttggctgggtgtgggacgggagcagtcaccgcaagatccccagacatgtgtctgagcccctgtgtggcctgaggctctcccagttagtcatggcagtagaaagtctctccctgctcgagatgcaaaagactcaccatccaaagagttgggccatcccctgcccgctgtgactgtctagctgtctgccccttgacagggcccaaaatgatccagtgctggaggccggctttgcaaacccaaggcagggtctcactgtgttgcccaggctggagtgcggtggcccaatcagctcactgtaaccttgaactcctagactcaagcaatcctcctgcctcagcctctcaaggagctgggattacaggcatgcaccactaagcctgactcatttctttactttttgtagagatggggtcttgctgtgttgcccaggctggtcctcaattcctggcctcaagtgatcctcctgcctcagcctctaagagctctgggattagagatgtgagccactgtgcctggcctcatgataactttttataaagaaaaaaatttaaatcctctgtttcttctcttcctcatcttcccttactttacccacaaacaggggaagaactttctagcaggaaccatttagttctgtcttgggagcacttgtttccttctcagtttcttagaaagtgcagagtctgcttgctggcaccgcaccgtatcaaatgcttgtgatttccattcggcctgcacccacggcagtgggctctgcccgactgctcctcagcgggggcctgggagggggctgaaaagcctggggctggtgggaagtggtactccctccagcatggcggtttggagtcttgaggaagggtccccccttagccgtggcccagggacactgcccctccccacccccagacccttcccgacaacactgcctgcttgggatgctctaggcagaagtgggcggtggggctggcctccatttcagtgcttggtaattttacggttggggtctccgtcttagaagcaatttcccataattccacttgggagagaagtgtctttattgctcatccccattttaaaggtgggtaattgggggcctcaagagattaggagtcttgctcatgataaaacaggaagtggtgggtctgcgatttggaattctgcgttcctgcaggacaccctgccgcccgtgccacctgttctctcccacgtgatgggcgcaaacccctgagaggtcccttttcagctcttgctccattctcagctgttgtgtttccctctccagatcccccacattgacacaagagatgtgatgcctccgggcagttaagggtgaaaagcgaatgcaggttttctctctcctctttgcccccaatcctacgggtgaatgaggcttgcatctctcttttgctaccatcgagagcagcagctcagtcagctaacttccgtttgcctgccggcatgagttcagcgagtttccccttggttttagagccaaagcctgagcacttggtgtaactttgcgtgctgtcgccctgagaggcggcaccgtcgggccccgagtcagccgtgtgctcgaaccgccccactttaccattcctgttcctcaccggtcactctttagtagagtcccgtccacttaaggagcacttcatacccatgaattgagtaaaattattttacagcatatggcatttttcatgactataattacaaaggattctagacgtcattgatgggggttctccctggcgctaacactgagtgagaagttgacccagttagattaaagctcaagttaataaacagcattcacacatttctaggcctgttgaccaatatcctttaaatcagtgtggctttccaaggggggagcaaataaaaccctaaggtagccagagtgctgttttttccaattaaccttgttcgttttgatttcctttcggttcagaacaatttaggtcaatcttagatttttaagaatgaacctctggagggagaggaaattaactaggccctaagggggcttggttaccacaattaaccccaaaagacagactctcaggctggtggggggcctggagaggggccacatgaccacttcaggccatctgctcacatggagaccctggtgggagtgtcctcttttctttcctgctggctggttaaataaactctgcaggctaccacgctgacgaagggtctgcccatttctcatgctccttctgtcttttagccaaagctgtgttccctctctttctgagaagagggatcagcaaacccttaactcccagagatcgctggtggagttcagggatggaagtgcctgatccaggcagacctaaagcagaggtaatggaagagagatgggaggacagagaagaaaagaagggcgtggggcaggaaggcagggccagactcctttctgtgttaggagcagagccttccttcaccggagcctgggcagtcaatcaccctgagagcgctgggagcctttcatcatcatcagaaggcgttgtgcgtggtgtggatgcacacgtgaccgtgtgccgcacctttgttctgcccgttccttactccttatttaggtgatgaaagatgtggtgccccaactttaagttccacttgacgcagaatttcctgattgaggatggagcctggggctaccttgaggtaattacgggatagtcgttgtacctggaacgtacatttttctaaagttgccacacagtaagactcccacagttctgtccacaccccttcccatgacattattgtttcttcaaaagggaccagccgctgagattttgttagcagggaaatctgtttcacaggaaggagggatgtgtagatgggacctaaacatcgaagtttataatttggtgaaaacctgataaatgggaagaccatttgaaatagatgtttcagtggctgggagtcccagatacccttgaatttaacactgctcattacatacctcagtgaccagaaattggagaccagcctgggcaacatcgcaagaccccatctctacaaaaagtaaaaaaaaaaagagtcaggcttagtggtgtgtgcctgtaatcccagctccctgggaggttgaggtggaaggattgcttgagcccaggagttcaaggtgacagtaagctgattgggccactgcactccagcctgggcaacactgtgagatcctgcctctaaaaacatttttttaatatcatcataaactctgtcagaaatacaaaggagcataaagaatgtaacaaacaatctgtatccacaatctggcctaataaataacacattaccatcccatttgaaggctttttgccagacagagggcaagtccttgagcgggcgtccagtgcaggtgtgctgaagagcccagcctcaagcctaaaatgggatagtacaggacatgaacatgtgaggcaagtggatcacctgaggtcaggagtttgagaccagcctgggcaacatggtgaaaccccgtctctagtaaaaatacaaaaaattagctgggcttggtggtgcgcacctgtaatcccaactagttgggaggctgaggcaggagaatcgcttgaacccaggaggtggaggttgcagtgagccgagattgtgctgttgcactccagcctgggttacaagagcaaaactccgtctgaaaaataaataagtaaataaataacgacatagaagacagaatatggtaggcggtaaaagggaaatgctgagcagcagaatgagagtagtcagagttaagaagagggaggcatcttgggagatcggctgaatgagggcaaacttgatgaaggaggtggcatgtcagttgggccacggagaacgggtaggattatctactttgttctgcatacatctccctaacccttcccttaagcttctcttccaaagtttctctgggaagtttctctttcccttcccagactaaagctctttccctgctgtttgtcctctcttgcttggctcaggctatgatggaaaacgtcctcaggctgggtttctgggtgccagatggcagccaccatgggaggaagggtggccgagtactctcagggcccggctccttggtgaccagccaggtgccctccagccagcggccccagcatgacacggtccaggtaacctcccttcaccgtgctattgggagggtgttttccaggactggtgtgaagtagattcagttcccgagaaggacagagctgcctgatgcgtgaacaggcctctctgagaccagggaggccacagctctgagacatgaagcagatgctgctcctcagggcctgtggagagagaactctaccctcttccatttctgaaagccagtggaggcttctcctcctctggaggattcatttcatttgttagttaacgcatccattccttcaacatagattcattccatgtcagctctgccccaggccttatgctgggctcggggtgtggaaaatggaatcgaagctggtctctgctcctgagaggcttacagccccttttagggtatgtgctggatctggaaagctgggatagaagaaattgggtgactgtgtattgtctttgtgcttttgtgtttttttagaggcttctatgatcagaatatttttggactaatgatgtgagttccttagataatttgaaaatgtgcccctatattctctactgtttagagtggtataatgttggcatgacctcatcttcctttcaagattacatattaaaagaaaatttgactttatattaaacgaagtcaaagctgggttcagtggtgagcacctgttgtcccagctgctagggaggctcaggcagaaggatcacttgagcccaggagttcgagtccagcctgggcaacataatgagaccttgtctctaaaaaaaaaattaattaattaaaaaataaataagtaataggaatcagaccccagcatcatagttgtgcatattacctgttatttctttaagagatatcccttctccttgagttccatttttatgggaattacttgctttaaaaaaaaaaaacacacacacacaaaaacttcaaagatacagcattgacatgacgataaacttccatttctttaaataagctccttgcaacatctgatgtatctgtaacaaaaagaagggcaggagaaggagcttgcatttatgtttatgaacagggtaaactcagagacttgcaacctttaccccgccctcccccaccccaccctcaagaagtcccgaagaacaaaaggcaattcagatggcagaatattacttctgttgctgtagcaccaaactattaaaaataaaactgtccctcaaggcaaaacatttcatttattttcctttgaatgagtaacttgtttattaagatgaactaagtggctaaatctagatggtacgcaggcaagaaaaattgatgtattgtagcctttcggaaagtatgctttatgttccctggaatcatctctgggttttaaatgaagaagagctcgtttagtcagatggggagctgctctccctggaaataggcatcacccggctctgcaatgtggaatgtcatatttgaccttggttctttcgcaaattggttctttctgggctaaatcagtgtgttgaaagagttagctaggtttagtgatcttcaaaggaggaccacgttcctgcctcaactgcgtctgcagttttttgaagtgtttaatataaaatcgtttcacttttgccttatttcatatttgagatcactgtgctactgcatctgttagagaggcaacacagagcacagggagccaactgcagtccctggagcttctgagagagctccctttgttgcttcctgacccagcctcagaggcatcccgcccacagggaaggatatttgtctcagcagggaggttccccattactgtctcctcatctggggacacaaatgtgatgtccaattcccctctgattgaggtctcatttgccctaaactaatgcaacttgaaaggagaaaagggtgtcaatggttaaaacaacaacaatgacaagaacaacaaaaacctccacccaatttagcagtgaaacaggaaacgccgtattgaggagagaagcttttagttggaaaaaaaatttctctttagaatttggacaacaaatgactctcactctcttttctggtggtgattgttttatttgttaatttttttttttttttttttgagacggagtctcgctctgtttcccacgctggagtgcaatggcacaatctcggcccgctgcaacctccgctgctggggttcaagcgattctcctgcctcagcctccctagtagctggcattacaggtgcccatcaccacgcccagctatttttttttgtatttttaatagagacggggatttttaccacattggccaggctggtctcgaactcctgacctcaggtgatctgctcgcctcagcctcccaaagtgctaggactataggcatgagccactgcgcccggtcgattgttttattttaatatcacgacacacatattattcctgatttgtaatctcacgatacccgccttgctcgccaagagtcctgagtgctggcctggtaaagatgattatctccatctttcagacgaggaaaccaaagttcagagcacaggtccgcagaacagtcacagctgccagcagttgcacacccacatgcgccatcccatttgatcatcaccaacctgccggttaggttttcttgtcacccgaattttacaaaagtggaacagaagcaccgagagaataaatgagctgcctgagattcatcaactgctggtggaactgggcttagtcctgcattctttccaaagcccccatgcggtgactcagtatttggccatttttctttatcctttttgcctggtgactctgaagagagcccacctacagtccagcatgtctggatcctgtgcagcgggcagaggccagaggccatggtgggggccccagaactcaggctgggaatcccaggggctactccagctttcatgtcaccagagcagtgacattcgggccctcgggggcagactgtgcctgtggcttctcagtggggtgccttagggtcccctcagcagatggatcccatctcctggtctggttagcataagataaacagggatagtagcagcagttgtcactctgagggagggaaggggaagggagggctcaggtgaaaagcagaagggaactctatggctgtctttcttctccctgtttacctgtccacccatctgagagataaaagaagagcagaggagggtgagtgaggaaaaagcaggagggtattgggtgtggggccgatggttttcactcaatccgccgggagatctgaatatcaactctctatggaagaacaagaaccgaggtgtctcttctgccccatttctagcccagggtgaccccaggagctctgcagtgtgccgcatggaatcgcctaagatgggactgccttggaacaaacagtttcaatgtctatttcacatgtgcgctctagctcagaattttaataagcaaatatacatggtaccttgccgtaggggggctttatgtttctaaatctatgaattaataaacaggatgagcctttttaaaaaagggagcttggggcagaatgaaccactaaaaagttattggctcttaactcctgctttttgtagaagcttgacaggcagctgactcagccagacctgaaaccctttccccggttcttgttggcatttctgactttgccatttcagttggcactgacccttccaagactgtgtatgccaggagggagcatctgcccccatctactctctgggaagatgtcctctcccaagagtcaagagtgtcttgttctgaccgtgggttacttctctgtgtctgtctgagaggggaaagcattgtcatcacacaggaggtagcaaatacctacctctttttttttttttttttttttttttttttgagacggagtcttgctctgttgcccaggctggagtgcagtgatgcgatctcagctcactgcaagctttgcctcccgggttcacaccattctctcgcctcagcctcccgagtagctgggactacaggtgcccgccaccacgcgcagctaattttttagtttcaccgtgttagccaggatggtctccatcttctgaccttgtgatctgcctgccccggcctcccaaagtgctgggattataggcgcgagccactgcgcctagtctgctctggtttctaatagaagtaggtatttgcagctaggcgcggtagctcatgcctgtaatcccagcactttgagaggctgaggcaggcagatcgcttgagcccaggggtttcagactagcctgggcaacatggagaaactccatctctacaaaaaatacaaaaaattagccaggtgtggtggcacatgcatgtagttccagctactcaggaggctgaggcgggaggatcacctgagcctaggaggtcaaggctgctgtgagctgtgattgcaccgctgcactctagcctgcgcaacagagtgagatcctgtcccctccaccccaaaaaaaagaaaacaaagaaagaaaccagaacaccaggtgtgtcttcctgagttttcaccctgatcactgcctctcctgccagctccctgctttccagggaagagttggctgcgccaggggacagagcactgactcccacccaggccactgggacagccatatctaggcctcaaaagactatgggggttcctagcaaattccaccttatttgacttctccgaacagcccaaactctgctgggcttcttcccttgccttcataggagacttgatgcagggggcagaggtgagagcccagggggacagctggccttcaggaggggtccttgctgggtgtttccaggagagcttcggcctctctctccgcaccatgttccaggtggcgttgaagaccagtgggtaatttggggggtgtgggaacagaaaatcagaggaacagctagtgttttcttccttgagacttgtttcccctttgacagtttagatggatagtaacaataatcaccgataggaaagtcatcctgactggggtctgaagccttccgtggatgttcccgtctaattctcacagtaaccctgtgggcttttaaggtaagaatgatcactgactccacttttcaccagtgtcggaactgagacttggagaggttcagtgaccagacgatggagtccagggtccagggtccagggtccagggtccggggtccagggtcttcacagcctgtgctccctccccttccgtttctcctcttgctttgggtttgggaagcctccgcggggtgaggtggagagtgcgcctcactagtcaggcaccccgaaggagtaaggcatgtgactgtacaatatcccaataaagcgtgtgggtggtggggatgggtgggcgaggttgagatccattctttaaggcattaaatactgtctctttcaaaaggaggttgtgctgttttgcagctggttttctttaactaccagaaacaccagcattgtttcagaaagccacagaatttccaaacacaatgagaattccaagaggatggggtgtgggttttgggggctggggtgggtatggacaggcttttggggagggaagaccacagcctgagtggttttgtcccccacgggtaatgaatttcacacggctccactgtcctcagttttatctgcaggatgctcaagttgaagcctgggaaagaaggggatcgggaaggagcaggccccagggattacagtggccataaaaaccaaacagtgacccaggacagccccatttggtgtgacctctaatgactgccttccctcagctggtgtcagaggaggcacatggtgtcagttaagttccaaagtgacatttgtataaataagtttgttaatgggaaatgagtttttttttctccctctccaatcttaagaaagtgtgtagcctatatccaaatatttctgaaagagcatcaacagtaacggcaaacaggggagctaatgtcaccaacaaaacttgtgaggtcaacccaaagaaagaagggaataaatgagcaaaactttggaaagagtttctcacatgctgaaaacactcagcaatatttctaacaagcgtggtggcccttcagtcagaagtggcctttctctgaagtttgaagtaaaaaaaaaaaaaaaaaaaaaattctgttcttcctgcttttttttttgagatggagtttcactgttctcacccaggctggagtgcaatggcatgatctcagctcactgtaaccttcgcttcccctgttcaaaccatctcctgcctcagccacccaaatagctggaattacaggcccctaccaccacgtccggctaatttttgtatttttagtggaaatggtgtttcaccatgttggccaggctggtcttgaactcctgacatcaggtggtcagcttgcctcggcctcccaaagtgctgggattacaggtgtgggcacaccgtgcctggcctattcttcctactttttatactttgtgtttgcattcaacttgacaaactcaggcagccttaccagatagcttggtatttgtgagattcagttctgagttttgaagtaaaattttaaatgtgattgtttttatcctttaaagtatagagaagtcaatagccttggcttctaggtctgactgactgttctatggataatggatatggataatgtgaattggaatttatatccgtggaatcaaacatgttcaactgcatgacatgcatgacagaaagtggcacttggcagagacagagagggaaacagtcattctcccgagctgtgaagagtgcaactctagagtacattctcagttcttttatctgtggaggaaaaggcacgttgtcatggttaagaaatatcacatgccaacttagtgacgggggaaagaccctcttaacaaatggtctgggccgggcctggtggctcacgcctgtaatccagcactttgggggctgaggcaggcggatcacctgaggtcaggagttcgagaccagcctggccaacatggtaaaaccccgtctctactaaaaatacaaaaattagccaggtgtggtggtgggtgtctgtaatctcagctacttgggaggctgaggcaggagaatcgcttaaacccgggaggcggaggttgcagtgtgtcgagatcgtaccattgccctccagcctgggtgactagagtgagactccatctcaaaaacaaacaaacaaacaaaaacactaacgtatactctagaggcttacacaattaattgtagaaaatgaaactctgaaagaactagaagaaaatataggtgaatttttatctaatctcaaaatagagcagccttattaaaatacgacagaagggaagcaaaatcaataaatgagcctgaggttgaattacagattacttgtacaagaatattcatagcagcaccacagcaaaaccttgaaacaacccaaatgttgcatattgagagtggataaacaatagagtttttcacacaaaattttcaaaaattttaaaaacaatacccccaaatcgacaaattgtaatgacatataatcctatggctaaactttacaatataatattaagtgcaaaaaacgttacttaatacacaatagcctttcttaacccaatgttttaatatgaaaaatttcaaacattcagtaaaactgaaagaattttctcgtgagtacctgtatgcccatcatcttgtttatccctttcacactttgttatgtttgctttctcacatactcattcattattccctctaattcagcagtcctcagcttggggtgattttgccccccaggaatatctgacagtgtttggagacagttttagttgttacagctgggatagggtactactgacatctggtgtgggtagaggccagggacgctggtcacagcctgcattccacatggcaagcccccaccacagagaatcagctagccccagattgcagcagtgctgaagctgagaacccctgctggaatccatcttattttctgatacatttcagagaaacctggattcactggtatacttcctcctacatatttaagtatgtatatcattaactagatttccatatttatttacagtgtttttcttttgatgtgaaatgtacatgcaatgaaatgcagaagtcttaagggtacattcactgagctttggtcagggcatgcacctgtgtaacccagactcctgtcaggacagaggaccttaccattggcttagaaaatcccccttaactcgtctccagtcaagcctttcagcctcctttccccaggaggcaacaattattctattttttttccaccatagaaaaaagttagaacagtggttctcatagttttgtgtgttttagaattgcatataaatggaataacaacagatgcacgctttgtctgagacttctttcactccatagcacagcagttctgcaagtgtgttctgcagacctcttaggttctccaacactccttcagggggtcccatatgtcacagctattttcattataattctgagacatttttctcctctacactgtgctgacatgtacgtagatggtgcaaaggtaacggtgggtaaattgaggcagtagcaccaaactgtacctttgtcagtgtgttcttcatcaccaccaacttacagaaaaaggagtcagcatcacttaaaaatgccctgggtgaagcagaacagatgtgcatctttttaaatctcagcccctgaatacatgttcttttaatattctgtatgatggccgggtgcagtggctcacgtctgtaatcccagcactttgggaggctgaggcgggtggatcacctgaggtcgggagttcgagaccagcctgaccaatagggacaaaccctgtctctactaaaaatacaaaaattagccgggtgtggtggcgcgtgcctgtaatcccagctactggggaggctgaggcaggagaatcgcttgaacctgggaggcggaggttgcggtgagccaagattgcgccactgcactccagcctgggcaacaagagcaaaactccgtctcaaagaaaaaaaaaaaaaattctgtatgatgtaatggaaggtcctcataaagcacttccactccaccgtagtagcacgattgtcttcaggaagggcgtatacgcagttgtttgagttgccagccaagctagctgcttttctcatggaacaccatttttacctggaagagcaactgaccaactacagttattcaggtttgcgtatgtggcagtgaagctgtcacttcaagggaaacagctgacagcatttgttgctattgatacaacttgaacttgcaaggaagaattagaatttttgaaaacttgtatttgtcaccatgaacttgagagcttcccaataactaacaatttttctgacaagattggtggtgatattgacatatgatttaaaaacataatgacatgcatcaacatttgcaagatatgtataactcactgaataattattttctaaatgacctgtgtaggatattatacagttatacacaggtaaaagttccattccaactgtggcgtagaccaatggatttccatgtagtggagtagaaaaagtttactgataacggtttcagggcccatattgcaactaacctttaagaaactaccacttttaaagttttggtttgtatcaaagatgaatagccataattatctgaaaaggctattaaaatagttcttcatattcctacttcatatctgtgtgaggctgagttttctctatattctccaaccacaaaaacttccagatgagtttccaaggtagtttacaccattttacacttctaccacaatgtctgagactataatagcctttttacaaatttacaacagcaaaacacacaatttcagaattcatagagatgagatactactgtgtaaaaagcaaagctggggactgatacccacaggacttgaggtggcagtaaccttgggtgggagagtcctgcatagccagatgtgtacctggtgaagggccagttaaagcgctgttgtttaaaccaaggagaagggtcctgggggtgccctttgccataggaaactatttcccatagtattagtatctgtggctaacaacatggccacaggctgtactttcctgtccaatctctgtgtatctaagtctgctgaggctgcagattcctgcaaagagcagtcgatggccctctgcaggagggctgatggagaaaacatgcgtcggatgcttacaccggccgtgtcagagaagaggaatgagcctattgctcctgccatgtaatgattcctgttgggagtcagtgactccttttctgtggggctaccctcacccatccacatttctggctttccttgctaggggttcttccctcgtcttccaagtcctgtgcaggtggctggaggccagagaggactcatttggctataatcagaggcattcccctttcctcggtccgtagggatggaagggtttgagcccgagtttatttacccttagcaaaacacaactaggttttattattattattattttagtgcttgggataaaaaggcccataaaaacaatagcataaaacagcttttactgatcaaacgtcatgctgatttatttgtgagtgaaatctgaaccatatggtctggcttcccttaaaatgcacagggggttcaggattaagggaacaaactcttggcaaatttgttttgcgtttcactgagcacatcatgttagaaacaaaatagagcaattgttgagtgcttactgtgtgcaggaaattgtgcttagtgattgatgtccatgatctcgcttcatcttcacaacgatccatgcagtcagcagcgttccccacgaggggcagcagcagtgctgagctcagggccctcatgacctgcaggaaggtgggcaaagtggggaagatctggaatccagtggggaagagtcgtccaccagtgacagcacttccacctaaagtcccctgatcgtgaaagagatgaaactgcaaacgaggacgtgaacttggggcctgtggatcagctggccttctcaggttgcagagagccagctgtgcattgtcttattcccttgtcccagcagagactgaacgctaagtctttcccaccatcaaggcatgaggtttctctctttgccgcatttgtgttgggcatctcagccctcagtctgtattcttgtggagggtgcacctctttttttttttgtttttttgtacacacagttttgctcttagttgcccaggctagagtgcaatggcgcgatctcggctccctgcaacctccttttcccaggttctaagcgattctcctgcctcagcctcctgagtagctgggattacaggcatgcaccaccacgcccggctaattttgtatttttagtagagatggggtttctccatgttggtcaggctggtctcaaactcccgacctcaggtgatccacccgcctcggcctcccaaagtgctgggattataggcataagccaccgcacctggccagatgcatctctttgagtttgggaacgaaaagggtatgatggcagaatcatgtgctgccagtcatgatcacagtgatgttcattctggttcctgggcttaagcttctaatttgctgtaagaaagctcagtgggcttgccctttgcctaagtgaaaccagcttatttccacttttcttcaggcaccctcacggacatccagtgccacggtcctgctttgtcaggcagcatctttcagattcttgaaagacaggcagcttgtttcgaatgacccacagggaatggtgcaccattcactcagtccacccctagcacgggccagtcctatgtcgttttttggcatttttgaggaacagctcccttttcagtaccaggtgacattattacccagatccagttgcggagaggcgtgtgtgtctgtctggttgagctgaaacgtgggcagatcagaaaggaaggaaaactggattaagccaggatttgcttacctggaaggtccagaaagaaattccccttccttccacagccagaggatttcaagtctataatgttgctaaaattagcagtgtaacaaaacttcccatgtgatgtagcacaggttgatggggtaagccagtgtaacatggaaacccactggcacctctgcatctgggcctaaggctgcggcctccgtcctcttcgccatcattggcctctcttgtttcttcccacccctgtcacaccgcccttgaccatggttgtctgtcatgtggattcctcacgggcagagatactaccctctgagcttgctccctgctttgctctggagtgtggaatttaaaacttgtaatgataggagaagggaagaacacagttacagtattagactcactgtttcctgagccactaaatgtatcagactgttatatttgggttattttccaaaaaccttttggtagtcattaaaaaaacactctgaggctgggtgtggtggctcacgcctgtgattccagcactttaggaggctgaggtgggtggattacctgaggtcaggagtttgagaccagcctggccaacatggtggaaccccatctctactaaaaatacaaaaaattagccgggcatggtggcgggcacctgtaatcccagctacttaggaggctgaggcaggagaatcgcttgaacccgggaggcggaggttgcagtgagctcaggttgcgcctctgcactccagcctgggcaacaagagcgaaactctgtctcaaaacaaaacaaacacactgtggctatatttattcatggaaacaatgatataacattcttagacttgccttcaaaggccacctgtattaatagggtcccacgcatgccacttataacatggattctgtagcacattgggacatcggaagccttctccattcactctcccttgctctccctattgttccagcacctcctgagggggccctctttcaggagctttgatcattccctgcacttgtacatttccataactagcaccacctttgtatctagatgtttgcatgcaaggggcatctccaggtatcttcccatgtatccttagttgcccaggcgggcggatcacctgaggtcgggagttcgagaccagcctgaccaacatggggaaatcccacctctactaaaaatacaaagttagctgggcctggaggcgcatgcctgtaatcccagctacttgggaggctgaggcaggagaattgcttgaaactgggaggtggaggttgcagtgagccgagattgcaccaccacactccaccctgggcaacaagagcaaaaactccatctcaaaaaaaaaaaaacaaaaggcagtttccgcagttgtaagtaggactagaggaaagagtgatgataatattgataacaataaaatacaattattgagtgcttactgtatataggagatacacttagtaatttacatgtattatctcacttaatcttcgcagtaatctgaggagataatgttaccctcattttgcagctgaaatgtagcaggttgcttcacccctggaggctgcacgcctagtagtgatggagcagaggcaggagcctagcgtcacctgactccagagttcattctccaatcaccgcatgatactgactcctaatcgtagcctgatggctttaacaagagaaaataaggttaccttccagctagagggatttattattattattattattgtatttctttatttattttgagacagggtctcgttctgttgcccaggctggagtgcaatgatgcaatcttggctcactgcagcctccgcctcccaggttcaagcgattcacatgtctcagcctccctagtaggtcagactacaggcacgtgccacgatatctggctaatttttaaaaattttttttagtagagactgggttttaccatgttggccaggctggtcttgaactcctgacctcatgtgatccacccacttcggtctcccaaagtgctgggattacaagcgtgagccaccgccccctgccggatttatcttacccatgtgtctctgacaggatatattgtcaaattcccaaactgtatttttaggggggttgcaaattttgcttccaaatgatcttctaagagcaggatattctctgcctggagtgatgagggtaccatttctaaaagaggtacattgtagttcaaactcctgcaggtaaggagccgtgacttactaactttcaactttgacacattcgcaggtaagagcagagctacgcactacagcaaaatccaggctgtccgtcagcagctgatgtgcccggtaccttttgtcttggccatcctgttgttcattaatctgatgtatactcactgtgtttgcgtttattttcctaacatttttagcctcatcctattcctataagtgacaggcactgtaactattgaaagtactgattaaaagtagtgtttgattattctgtaagcaaagtaatactttggattaaaacaaagtgactgtcatctgaatcttaatttctgttattttccaaatttctttattcattctcctgttgatgtatatgaagatgaacaaagagagcaaataaaaccactcagaggccgggttcggtggctcacgcctgtaatccccgcactttgggaggccgaggtgggcggatcacaaagtcaggagttcgagaccagcctggccaacatggtaaaaccccatctctacaaaaaatagaaaaattagctgggcgtggcggcacatgcctgtaatcccagctactctggaggctgaggcaggagaatcgcttgaacccgggtggcggaggttgcagtgagccgagatcgcgttattgcactccagcctgggcgatagagcgagactccatctaaaaacaaaacaaaacaaaaagcaaaaaaaaaaaaacaacaacactcagaacccacacctacagtgtaactagagacgaggtgtaccgcagacttggggaaataaatgtcccgaagcagcagagctaactcccagctcccaccaaaaacgatgttacttccaaagatactgcacttgaacaactgaagagagtgctcttgaaataagaaacttagaggcacccaagggatttcagacctatttttgctggtctaagaaaatccaattgatgtaagaatgaccagaaaatggcagcaaacatccataaaaatttgctataaaaagaaaactgccgggcgtggtggctcacgcctgtaatcccagcactttgggaggccgaggcgggtggatcacctgaggtcgggagttcaagactatcctgaccaacatggagaaaccccatctctactaaaaatacaaaaatcagccgggcatggtggcgtgtgcctgtaatcccagctactcgggaggatgaggcaggagaatcgcttgaacccgggaggcagaggttgtggtgagccaagattgcgccattgcactccagcctgggcaacaagagcgaaacttcatgtaaaaaaaaaaaagaaaagaaagaaaggaaaaagaaaacgaaggaaggaaatactccctgaaaacaaccatgaagaaaatgaaaattgttaacaccacctccaacatgaactaaatataattgcacaagcatttaaagaaatgaaagaaaacctaataccagaaatttgaaaaatctcaaacaaaatgctggaaaatgtaaaattaaagattatgacatgccagaaagaaatggaggaaaaagacaaaaaaaaatcatctcaggcatgaagacgagattacaagatgtccattcagattctactgaaaaaaattataagggatattgagaagaggaacgaaaccattcaagacaacaaaaatgagataaagagaggtgaaaagaatcagagaaaaagtgatatataagctaggcaaagaaagtccaacacacaaaattgaagttgaagaacaagcagatggaataaaactaatatttaaaactacaatctaggctgggcgcagtggctcacatccataatcccagcactttgggaggctgaggtgggcagatcacctgaggtcaggagtctgagaccagcctggccaacatggtgaaaccccgtctgtactaaaaatacaaaaaattagccgggcgtggtggcaggcacgtgtaatcccagctacttgggaggctgaggcaggagaatcgcttgatcccgggaggtggaggttgcagtgagccaagttcgtgccactgcgctctagcctgggtgacagagcaagacttcgtctaaaagaaaaataaataaaactagaatccaagaattctttatggaaaaaagaagatgtgactctacatactgaaagtttctacatgcatctgggaaaattgacccagcgtgattaaattctagatgtatcctcataaactttgtggttaaagatgagggagaaggaggaggaggaggataaggaggaagaggaggaagaaaacaaacctctgggcctccagtcaaaaataccaagtcacttaaaaagaaaaaaaaattagattggcatcagccttatcaacagctacgtgcaaagcaagacaaggatggaacaatgttttcaagaaaggtaaggaccatctgaatcaagaattttaaatccagcccatctgtctttcaagtatcaaagttatcgaaaaaaaagttttaatcctacgagaactcagggactactgtcctaacaactccttcctaaagaatatgccagagggttgttaccatcaaacagagagaagactaaggaaatttgtcaaaataactggtggtttgaacaaaagatgcaaaactactttgaaagagggcttcatgtttcagagattaatcggacgtatccatccataagatccttgccaagaaagtttgaataataaaacaatggagctagattgcaatgttttcaccaaatccagaatctctgaagaaattaggatatggctttggcagctctagacgccaaatttgtaaagcaagagaagggaaaaagtgcaagtaattaatggagcttggaaaagacctgaagcaggacagtcaggagtagatgaaagggttttctaagaaaagaagtagaaatgtggaatttggtaaattttattgagaaggcacccgagtagatttaggcttgtagttcttacaaacattaaaaatgttttattgtattaaagagctaatactccttaattatgacttcattatttatgttacagagaagatctagatgcactatttacctccttttgttcctaacctagaaatggtagcaaatacatgtggtttcatttgttttttttttttttttgagatggagttttgctcttgttgcgcaggcaggagtacagtggtgcgatctcagctcaccgcaacctctgcctcccaggttcaagcgattctcctgtcttagcctcccgagtagctgggatcacaggcatgagccaccactcccggctaattttgtatttttagtagagacggggtttctccatgttggtcaggctggtctcgaactcccgacctcaggtgatccacccgccttggcgtcccaaactgctgggattagaggcatgagccatcgcacccggcggtttccttcctttcctccaaagtcacgttgcacatcaatatgtgatttggcaatggttctctttttcactgagccccagtgaagcctcagaattctactcaacgtagcacacgaggcagccattactactctatctgcatttgttggaagttgaaatatatttgctatccctgccctaattgtagggtctgtagcctgattacttggcatcttcatctcacttgtggaaactaacgggattacagacgcactttctcagcaagcgttcattagtcactgagtaaatgacaaacaatgtatgaggctctgggcataatgaaatgattaggacacatttccatcctccaagaggctcacagggcccagaaggaagtgaatgattctgtagaatttgccttgtgaatgtgttactccttaagttatatcgaacattgcagtgatcaagaaatattctactttgtagaaagatcctggaatcacatagaccccaagttttaggcatggcaaaactttatgcacaatttcatatgtaaagtgattttctctgtcctcatccttagtaccttgctactcaaagcgtgacctgaggaccagtggaaagatattacctgggtacttgttagaaaatgcagaattccagtcccataccagatctcttgaaacagaattctcattgtatgaagatacccaggtgacttgtatgtacataaagtgtgagaaacactgcagactcttagtgtccagctagaacaagattgatttgccacctgccacttttctttctccctacacacacttaaaaaaaaatctcttaactaaccacagacacatattccaaatctcatgttctctctgtcataattttcttatttgtaaacttaacatgggaacactattagtacctgtcctgtctgatgagagtgagcatttgctgagatcatgcatctgtggtgttcagtagagtgcccagcttcataaatacatgttatttgtgaatgatatacatgatactagtttaatggaaaattgggacttagaaataatgtttcgggctgggcgcggtggctcacacctgtaatcccagcaatttgggaggctgaggcgggcagatcacctgaggtcaggagtttgagactccagcctggccaacgtggtaaaaccctgtctctactaaaaatacaaaaattagctgggcatggtggcgggcacctgtaatcccagctgctcagggggctgaggcaggagaattgcttgaacctaggaggtggaggttgcagtgagccaagatcgcgccactgcacttcagcctggcctttagaacgagactccctcttaaaaaaaaaaagaaagaaaagaaaaaagaaatttcaacaccgtagcctgttcccagtggaggaaattctgaactttctcgttgttggaactttgtttgatacctctaagtaaatacccaataaaatggtatctaacgcccccctgccgggctgggtggtacccacacttgtacctcgcactcacactcacacacgtcacacacctgtcagggggcacagccccaggtgagcctgagtgctgtgcttgcctcgtggggtgctccatggagatgggtctcccaggcctcagggcttcctgggtgcacctcccgtttctgcgtgcagggagggatggctacaggactgggcgggagaactttcccagtgtggtgaggcgtgctggtgagacagcagtgtttcctgggttacatgtgggcaggactgggttggagatgggcccgcaatttggcctcctgacttggggtgctccagtctgcaggtggaagttcttcccggcggcttgcaaagaagaaaagcgaggagaagggcactgatttattcagcagggcatttccttggtttggctgaaagcttttgacttgcgtgagctcagcaggggagcgccgtttccaggcctcgcaacaccggcctgctattaagtgtttctaagagaataaaagcctgttgtgttaaaaggacttgccctccgccagcagcagtgggcccattagccaatccgttggacacccggtggcacacaggctggctctgcaggaggtcctcctggcctcctgcccctgtgtctttcagaaggcagagtccgtgggagagatctgcttccccatcctcctgcctggtggagctgagagtgtcaactgacactgtcccttcggcctcctcctctgtccctactgcgctgggttgagttgcctgtggaggggctccgcttcccttcctttgtggagctgatgtgttcaggaaaatattcgaatatgttagatttgtataaactaggtcattactctcttgctttaaggttatacttcaaaggccatagttaattaaaggtaggtgtcctttgtcattcaaagtgaacatttgtgtcagttcaataatatttgcttttaaatttccgttaagacatacgggttgggtgtggtggctcatgcttgtaattccagtgctttgagaggctgaggcaggaggatggctcgaggccaggagttccagaccagtctcggcaacatagcaagatcctttccttaaaaaaaaaaagaaaaattagccaggcatggtggcattcacctttaattctagctactcaggaggcagaggtggggggatcgcttgagcctaagagtttgaggttgcaatgagctatgatcacgccactgcactcgagcttgggtgacagagactctggaaacaaagaaaagaaaagaaagggagagacggagggagagaggcagggaggaaggaagggttcagaatatagaaagagggaaggaaaggagggagggaggaagggaataagggttcagaatatagatagaaaggaaaagtccacagaaaactggagtaaagtctgaagctcctgaaataatagtcagtgtgctaagcaggaacagtgtgtacaattttaagacatgagagtgaaataccgggtttgtcatttgcataagtttttgagtagttagaataaacagtgcttatcgccttcccaaaacaccccaccactataagctgcttgtacacactgcatcacttatttttttttttttttttgagacagagtctcgctctgtcacccaggctggagggcagtggcaccatcttggctcactgcaacctccacctcctggggtcaagtgattctcctgccccagcttcccgagtagctgggactacaggtgtgcgccaccatgcctggctaatttttctatttttagtcgagacggggtttcaccatgctggtcaggctggtctcgaactcctgaccttgtagtctgcctgcttcggcctcccaaaatgttgggattacaggcgtgagtgagcctctggcatcacttatgttttaatgaccaaggtgtatacaggtaagaaagttaagcatgtaagtgccaagttcatgtcttggttctatcatttaccagccatgggctttgggcaagttagttttaacctcattcagcctcaacgtcttcaactctaaaatgggaataaatgttgcctccatcatagatttattgtgaaagttaaaggatattgcgtataaaatggcttagcatagttcctgggacgtaattgacaatcaatattataattattaatatgtgaactataggatttttattatttaaaagaacctttaagtgaatttcttataaacctataatgttagcaatgctatgaataaaatttgttttataaggttgaagtttggtatgttgtattttcttgaagcaaattttataatgcatgcgacttgatttttccttgtcctttcctatttttggtaagaatgtctaaacctgaaaacaatggagtgtagaaataaaaatacatgatgcggaatctgagaatgccaatgctaggggaaaggaatactgagtgtgtgtggccgtgagccccgtgggggctgggatttgctcgctgctgtatccccagggcagaacaccatgggtggcatgcagtaggtgcctaatcagtgtgtgttgcttgaataaatgaatgagaccacatagcccaacaccttcattttgtagatggaaacataaggcacagagaagtaaagtgacttgtctgaaattacttaaggccgatctgggactgagtctctggtccgtgtgatcacaaatgcttctaaggctcacaacgtagcagaatttgtctgcaatgaagatcgtggtgtcttcagcagcacactggctggctggttatctctctttcttcctctgtcctctgctccctctttctacttcttcccttctttcttcctcccattcttgcccattgcccctggtggcgtgtcctttgctaaatgagggctagacagatgtaacttacagctctgtctcataccacgcaactctaaagtccatccttagactacgacttagagcagatgtgaatgtttaacctcccttctctctggacatatggcatcatcttatttctctgttagctggtctgccctcctgccacccatttcaaggcactgttggctcctggaagccatctggatggagtttttgtaacgggaaagtgctcctccagcacccaggaagccttgggtgggtgatggtccctgtgatcacccagccgtggtaaggcctgcttcccttgcttagcaaaaccgtaccctggtggatggtgatgctgcagccggggcccagggggtctatgagcatcatggcaaaaaagcctttatgggagctcccagtttactactttcagcctttcggaaacacacacatttccttccattctttactggcaacactgtcttttgtacagactgtatttgtttggattaatacagggagtctgcaaatttttgttcaaataagaatattgtagctgggtgcagtgttccacacctgtaatcccagcactttgggaggccaaggcgtgaaggttgcttgagctcaggagttcagagccagcctgggcaacatagtgagacctcatctctgctaagtaaataagtaaaaattaatcaggcgtggtgacatgtgcctgtggtcccagctacttgggaggctgagatgggaggatcacttgagccccggaggtcgaggctgtggtgagccatgattgcactactgcactccaacctgggcaacagagcaagaccctgtctcaaaaaaaaaaaaaaagttgttatttggccaggcatgctggctcatgcccgtaatcccagcactttgggaggccaaggcaggcagatcacctgaggtcaggagttcaagaccagactgaccaacatggtgagaccccatctctactaaaaaaaatacaaaaattagctgggcatggtggcaggcacatgtaatcccaactactcaggaggctgaggcacaagaatcacttgaacccaagaggcagaggttgcagtgagccgagatcgcaccactgtgctccagcctgcgtgacagaaacttcatctcatctaaaaaaaagaatattgtcatttgagaatcacaaaactctgatctttttaaacataggagagtgatatagagcagtgcttctcaaactgtatttgatgaaggaccagttttcaaattttccatatcgtgttgcagatcaacctatccatcaaagacaataaaaatgaatagaaaaatggaaaaaaatcccaaacccaaaagacattaaaaagtcctcaattttttttattactcagaacaattgggctgggcatggtggctcacacctgtaatcccagcactttgggaggcagagacgggtggatcacttgaggtcaggagtttgagaccagcctgcccaacatggcaaaaccccatctctactaaaaatacaaaaatttagctgggtgtagtggcaggcgcctgtaatctcagctactcgggaggctgaggcaggagaattgcttgaacctgggaggcggaggttgcagtgagctgagttggtgccactgcactccagcctgggtgacaagagcaaaactgtctcaaaaaacaaaacaaaacaaaaaaaccccaattgatctaaaattatacatattgctgcaaaaaattctaaatgcttagtctcaatttctacacttccttctgggtgttggtagcaaactctctgtagacccgactttgaggagctcttgatatggagacgtggtttcttacgtctaatttcgttttccaccatctactgcaagagttgtattttctgcctcacgtcgctgtccttctcccagcccattcattttacttcccctctcagaatggcctgtgtagtgggaggcccaggacatttagtggaagatggacatgggcaggagttaacgcgtcctccagagaatgcctccatgttcttccgtcatccgtgcagatatcaggctgcagtcccgcagaaaatgatgatgttgcacaaggcgaagaagcagatattgacatgaggccaataaaacaggtcatgagccaataaaaatgaccatctgattcactttccagaagagctacgttttaatgatttactagaaagcgaattctttctttgcatcaatttttatcaaaaacttaatgccattaataggtgaagaacacatttttgattcattgactaggattatggttagtaaaatgattttcttttgtttgggttttcattgttgttttagacagagtctctctctgtcgcccaggctggagtgcagtggcgtgatctcagctcactgcaacctctgcctcctaggttcaagcaattcttctgctttggcctccatagtagctgggattacaggtgcccgccaccacgcctggctaattttttgtatttttagtagagacgggttttcactatgttggccaggctggtctcaaactcctgacctcaggtgatctggcctcccagagtgctgggattacaggcatgagccattgtgtcctgaccagtaaaatgattttctgaatgttttagtgtttttccttccaaaagttgtctttcctgacagtgtatttttattttactatataaagagtcactttccggccgggtgtggtcactcacgcctgtaatcccagccctttgggaggccgaggcgggcggatcacttgaggtcaggagtttgagaccagcctgggaaacatggagaaactctattaaaaatacaaagattagccgagtgtcatggcgcacacctgtagtcccagttactcaggaggctgaggcatgagaactgcttgaacccgggaggcggaggttgcagtcagccgagatcgtgcttccagcctgggcaacagagtgagactctgtctcaaaaaaaaagagagtcatttcccgtgaaaaccacgtggtctttctgcatccctaggggttattctggtgcctaacgacttcctgagtccactttcgccgcttccatggccacattcgctttatttttctcttcttaggggaggggaaggcagggcatagttgctgtaatttgtagagttgggttgatcagtcgcaccttagtgtatatacctcagtgtggaaatgtctgaaaattgtaactttgggtttgtagaatttgttttccatttcataagtcctggaattttaaagtcctgcattttcggttcgtttagaggaagctgcatatacacatacatgtacagacatacgagtgtgtatagaatgtggagaaataccactgccctcagactctcgtgagattatatttaatctttttccttctagggaaaatttcaaaaaggtaggagggggctcgtgatatattaacatttttaccaaaagctctgttagggctggaggggagacagcagagaagagcaacaagggaagttttagtgagatatagccatatcagaaaagcaacaatacatttagggaagctgggagaggcaggagatgccgctgtgggagggagctggaaggctacagggacctgccagagggaggctggaggctgtgggccaggtggctcagggaggctggaggaaggtcagaaccagcctggcagagagcctgaagtgacttggagaatgaggtggaaagaaacttgcttcctctgtgccctgagctcaaagataaaggactctggcccggcccaaggtccctgcccccagagtccccgcccagggatcatggatctccaccttttcctactcttgggtctcacagggcctggggattgggaaacagagtattgccaagccttattaagcagctgtttattgggtcagaatacacctgtcaggaaaatcatcggtagtgagcagtttcttcccgttaccagtaaatgtcggaatttcctgagtgcagctctgaaggatttagaggtgtcattcccagagattagcagggacctaatctgtgaagtgaaggtggaatgaccaggatggccagagccagaggaagaccacgaagccagagggtgccccgacagaggaaaagcggccggtgggttttagatcctcatttggccagagggaggcagctggatcggcttctccagagcctgctggctggaggttggctgtccgtggtggtctggttctaagtaggagaagaggtggaacttggagctgggcaccagctggcactgctgtgttcagagcatgggaggaagcagcagcagcagaatcccaggacccccaaagtgggagaagggctcccaggtgccttacaggtcacagtcgagggccttcttaaaagctggcccaaacctgccctttccttgcagcccaatggcctcaggagacagtgactcacgctgtgtccacctgtgtcatcctgtggacagctggaggtccacgggaacagctgctatggcggcggacacagccccgtccagggcccatggcagccccagctggctgcccgctccctcctgtgggcagtgcttcacagcggcagcgggagcactgggtgcagcctctggaaggtctggaaggtgcttgctttggggactcggccctggtggatccccttagcctgtggtatgagctcagtccccatttctcaggtggccttcaaggctcattcctgactcacccagcctcatctccagccattcgagatgcaggcgttgtcattccttgaaattctcacgccttctagatcctctgtgcttttcatcacactatttcctctgcctggaatgtctgtctttgcctgggaaacaaaagagaaaaatgcctgactgttagatttaaaatagcatctcaaagctcacgttatttttaaatatttcaaacacatagataagaatagagaataacataatcccagtgctttgggaggccatggctggaggatctcttgaggccaggagtttgagaccagcctgggctacacagcgagaccctgtctctatgccttccccccccaaaatagggaacatattgaatgtccggcattagcgttatcagatcttactgctatgccgtatgtacttcaaatctcgttttattttaaagaatgaaacaataaagatttagctgaggcgctcagggtgccctttcccactcctggtctccttccttgcaaaggataatgtctacccttgtgttaactagcccatgtatggtgttctcatttgagctagatattctacctaagaaatctaaacacatacattgtattggactaataaaaagttgtatgtaaattatatattgtgcatgaccagcaattggccttttcactcaatatgatgtttttgaaatttattcaagttgacacatgtatagtattagcagctgcatggtgttccattgtatatatatgtggttttttgtttgtttgtttgtttgtttgagatggaatcttgctctgtcgcccaggctggagtggagtggcgtgatctcggctcactgcatcctctgtctcccgggttcaagtgattctcctgcctcagcctcctgagtagctgggattacaggcacgcaccaccacaactggctaatttttgtatttttagcagagacggggtttcaccatgttgctcaggctggtctcgaactcctgacatcatgatctgcccgccttggcctcccaaagtgctgggattacaggcatgagccaccgcgcccagccatatgtggtttatttacttctcctatggatggacatttcggatttttccctcagttacctacagtgctgctgtgtgcattcttgcatatgtattcttttgcacctacatggaagttctctgatatattcagaggagagaggaggtaaactgtcaagtcataagttgtacatgtcttcaactttacaacttatcaccaaattgctctccaaagtggctgttccagttggacatgcccatcctgtttctcccttgccaatacttgtctttatcaaactttaaatatttgccaatcacatgggtgagaagtgctatctcattgttttaacgagcatctccctggttcctggtgagattgaccatctttgcaaatgccagttgtgtttccccttccatgacctaaatgttcacatcctttgcccatttttccatttgatgcatatgttgtccctactgatgtagggtatggattctatatatatacatacatatatatatatacacacacacacacacacacacacatatatatatacacacatacataaaaggatcttttgttggctatgtgcataacgtgtttctcctcccagtctgtggttggtcttttcacagtgtttaaagagtctttttaaacaaaagttttaacttcaataaagccaaatttacccccattcttctgtattgcttatgctttttgagtggtttatctaagaaatacaaactccatctgtaataaaaatacaaaaaaaaattagccaggcatggtggcacacgcctgtagtcccagttactcgggaggctgaggcaggagaatcgcttgaacctgggaggtggaggttgcagtgggccgagatcatgccactgcactctagcctgggcaacagagtgagactctgtcttgtaaaaataaaaaagaagaaaaagaaagaaaggaaaggaaaggaaaggaaaagaaagataccctttctatagccttctattttttatttttcccttttttgacttttgagacagggtctcactctgatgtccaggttggaatacagtggtgtgatcatggctcactgcagtctccagctcctcactcaagcaatcctcttgcctcggcctcttgtcctgttgagtagctaggactacaggcatgcaccatcatgcctggctaatttttatttatttatttattttttgtagagattgggtcttgctatgttacccaggctgatctcgaactcctggcctcaagcaatctttccaccttagcctcccaaagtgctgggattgtaggagtgagccactgtacctggcctccttttatatttttttctaaatatcattctatatgttcttctaaaagcccatttgttccattactctgaaagacaatccaagatacgtcagagtctcttcttgggaaatatggaatgacgtcttgcatattgtcatgatatgtagtgggtgggtaaaatccgtgaaagggtgagtattttgcttttaaagttctgtgactatgggatggcactctaagcttcagctgcagttgggaaagacttttgctgtagaccaattttattgtacttagtcgagttctagagggagccaggcccagaaaatgagggggacatttacgtcatggaacacagaggaagactcatgaaatggcaagagaccctcccctcccctgacttccaatgtgacacccgtcttctctgtcctctctcttcatactgttgtcttaggtgttccttgtaaccagacttcaaactatctgaaaacgtttgtgagaaggaacacacagacacgcacactcacacacacacacacacacacacacacacacacacagaactgctttggacttggatacttcctagtcctcctgttattcctatgaacgattccttctgttcttctaagtcccttctactttattcagagattatcatcatgactgctcatgatggcagtcagtttatccagatcacaagtcagaagggtgaaatcggctgaaaagaggatgaaatgttttaaacgctcaagaatttccagtcaccacagtcctgaggttcgttgtttcttttctgtctgaaagctgtagaactccatgcagggagcctgtgagcctcggtgggctgatgaaacactcagaagaaaaaagaacttgatggaggcagttgcctgtttagcagacgggatctgaatggaaggtctgagggtctgcagatgtcagagctgtccatggctttgcctggtgtctgtctgagcgatctggcctttgtccctgatgcctaatctgcctgtttgtctctctgagatagccaccaggtggtctactgatgatcaaagccctcgatggtgcagactgctgtcacccctcggctgagtcccaagatggggagtttgagaatgccgagtcttgctgttgccctttctgaatggggtgatgcctggtcagatttcagtttcctggaacatgtgttaatggttctcagcagagggtagggctttatttacacacctggctcagtctagactgcagacctttcaaaggtttgcagagcggccgggcgcagtggctcacgcctctaatctcagcactttgggaggccaaggtaggcagatcacctgaagtcagcagttcaagaccagcctggccaacatggtgaaaccccatctctacaaaaatacaacaacaaaaaaaattgctgggtgcggtggctcatgcctgtaaccccggcactttgggaggccgaggcgggtggatcacgaggtcaggagttcaataccaacctggccaagatggtgaaactgtctttactaaaaatacaaaaaagccgggcgtggtggcgggtgcctgcaatcccagctattcaggaggctgaggcagagaattgcttgaacccaagaggcggagattgcagtgagccgagatcacactactacagtccagcctgggtgacagagtaagactccgtctcaaaaaaaaaaaaaaaaattagccaggcatgatggcagatgcttgtagtcccagctactcaggaggctgaggcaggagaatcgcttgaacctgggaggcggagcttgccatgagccgagatcgtgccactgcactccagcctgggcgacagagcgagactccgtctcaaaaaagaaaaaaaaaaaaaaaaagaaaggtttgcagagtaactttgtgtggctttcttgatcaactgtgggtggacttaagatttacagccgaataaaggacttaaaaatacagccctggaatttttgcctcttcaaatgtccttcttgaaaagaacccctttcagaaagttccactttttaggtggagccccctgagccaacgctctgctcttcggaatcattgatctgtctggggatgagcaatgctgttgtcttcatcatcctcgtcttcagcagcatcaacagcaaggtgaatatttagctggtacacatacaggtggccacaccactcaccacctgttaaaatattgagacactgccacacgtgttggtcaagagctgctgctctgagtcccagtctccccaccacccaggccctgcctctgggatctctgggacctccccacaaatcagcaatgaaagcgttggcacctgaccccacagtgggtctccagggctctgctcagcactccagctggtttatattctggtaggaagacagacacccacacacccactcccatagtcattgaggaatccattctgattgatgcccatgccacagagttgttaaatatcgtgaatttcaagtcatcctaagacaaaaatctgggctcttttctttggttagaagacaaaggaattccagcgtatgcagagctgtgtactgggttctttggagacattataatatatatagatgggccctgaaaggcttgcttgtaagggcagaacacacacacacacacacacacacacagacacacacacacagacacagacacacacagacacagacacacacagatacagacacacacacacacacagacacagacacacacacacacaaacttaaaaaagcaacatgtcaccacattgacactgatgtagattgtaagtgcagaggggccagagggtaaagatctagacagattgttcagagtgtaaatcacttagttttctgtgttcttaacagtgcctgccactgtggctgcttaggatttcttttctttttttaatatttaaaattttggctgggcatggtggctcgtgcctgtaatcccagcactttgggaggccaaggccggtggatcacttgaggtcaggagtttgagaccagcctgaccaacatagtgaaatctcatctctactaaaaaaaaaaaaaaaaaaaattagctgggcgtggtggtgctcacctataatcccagctactcgggaggctgaggcaggagaatcgcttgaacctgggcagggaaggtggcaatcagccgagatcctgccaatgtaccccagcctgggcgacagagcgagactgcatcttaaaaaaaataaaaataaaatttgagatgcttggaggaatagaaaattggtgaatgtttgaggcaggacgtgctaacgaagagaagaggctgacattctgcccgagaagcagggcacgatggcgtggcagccctgggctgtcgctggagcgagcttgtttatggaagtaagaggaagtgggcccgagggatgcagagcagacttgcagggtcctgaaggctggaaactagattttgggtgtattaggaaaatcatgaagacatgttgaagaactatcagccatctcttaaactagaaggcaggccttgccccagaacaattaagtcatctgtttggagaagagggaacagagaggagcctcgtggcctcaaccactattttatcgtgacattctgcagaaatcctggccattttttcttttgctctctgtacctttctgaacttctctgcagggaagtgttgcagcagatgccctcagctcaccagagcccgtgttagccctggttccggtcctcagtctcactgggtgataagggaagatgagggaaaactacttctatcagtcacagcaccaacagtgccaacacggccgtgcacatccaaatggcttcattatgctcaacagcctgggtgagtctgagccttacagctaagatgcattgctttttttttttccctcggtgtgataaaaatgctggtagtatacttttataccccaaaataactgagcacattgagaaagacacggcgacctacttgggaacttcagcagtattagctggaacgctgtctggacagtggaaggactttttgcagggagctgccgtcagaggactgagagccagcgttcagcacggcatcactgagggcgcctggcatgcctccgcctgcccgtgagaaggcacgcttaccttctagatttctcacactcctccagagttgcattctgcttccgtaactgtcctagaacagcatttcctgtatgaagatacacaggtttggccagagactgaactctggttacttcctgaacttgggaacaatcctcaccaaatccactaactattaatcatggtcacagacactctcttgcttttgcatgctctgctgtgatgaagattgttgacgccaagaactaaatcgtaatgagcccacgtgctcttcacagcaggctccgataacactttgtcgcttttatggttaaacctcctcgtaaaatctctctttaagcgaacacgtgattatccccacggtagtttaaactgaacttgatttgtgagtttatttcttcttttccatctgagatgtttgccaatatctctgacatatattctcctatggaaatagccagaaaatgatggatcgaggaaatcaagtgtaaatcagtctgtacctccgagtggaaaccagtcagtgggatgtgaatatacttaatatgttctgttgtcttgtgtattgaaggagccttcatggagattttatatctctggagaaactcctgcaggttgcctttttagagagaggtttgaaataagaacaaagaaagtgagttcgctttagctgagtaaggcagggggcaagtgaagcagtgttagaggaggtaatgtggcagctgtctataacaggtggagcaaggtgatttttgtgtgtttgtttgtttttggtttatttttgagatggagtcttgctctttcgcccaggctggagagcagtggcatgatctcggctcactgcaacctctacctcccaggttcaagcgcctcctgagtagctgggattacaggtgtgtgccaccatgcctggctaattttttgtatattttttagaagagacagggtttcactgtgttagctgggatggtctcgatcttctgaccttgtgatccgcccgccttggcttcccaaagtgctgggattacaagtgtgaggcaccgcgcccagccacaagatgagttttaatggccaaacagaattcctgtttcacaacaattgacattgtgtcggctcccttgtttgtgcatatgtgttaatctattttttttttttttttttttttgagtctcaccttgtcgcctaggccggagtgcaatggcatgatcttggctcactgcaacctccacttcccgggttaattatcctgcctcagcctccctagtagctgggactacaggtgcccaccaccacgcctggctaacttttgtatttttagtagagatggggtttcaccatggtggccaggctggtctggaactcctgagctcaagtgatctaccttcctaggcctcccagagtgttgggattacaggcgtgagccactgcatcaaaatgcaatttattttggatactgaatgcacagaactgatctgggaagcattgctttgttttggagtttgtccaggacaggttagaataatattaacatttgatctgaaggcaaccttacctagattatctataaattgttataccacgagacagaagaaatcctattttcccacttaatatctgtgttaaaaattatcctccaaatatctatcaaattttaaaaattatgaaacatattaaaaaatttaaatctataggaaataatataacatgatccgtgtagctttcatgcatatttagcatgttgacatactttcttcagatgtgttttttaatagaaacattattgtcgaaggcttcttatttccctcttctttccatcctgttgcactttctttttccttagagataaccaaaattagcctcctacatacttttatgggtacctacatctctttgtaggtaggcgtattatatatagtaaagtacaataccgtatattttgtatgctttaaaattatttaatatggtaagatgctccacatatcagttgagaacttgacagtttcaagatttatctatccatttggtttatttgaactgtggtataactttctgatgaatgactgtaccttgatttacttagcttttcttcctgtgatggacactgttacaagcggtgctataataaacttgtgcaagtaactcttcatacctgtcttggtcatgtaatgtgctggctcacaggacacatacatagtcttcagcttaactagatgttgccagtttgttctccaaaatggcttctctgcaaatctcactaccattccatattttcagattctaaaatcctgccatcctcagatgaggataaaacgatgttttcttgttttgagatggaacatcttttcatagttttattgaccatgggagttttctcttttaagaattgcctattcattttctttgcccgtgttttttctcattgtattgtcttatttgtgtccattattgtaattgaattttaggatatttgaatgtaaatcttttgttatcgtattgggggttcccaagaccacttctaggctcagtaactcactaggttgctcaagaggctcagcctatagtcctactcacagcaaagacttattacagtaaaaagatataaagcaaaattagccaggggaaaaggcacagagggtggagtccagaggaaaccacgtgcaagcttccaagagtcttctccagtcacataggacacacttcgtttccccagcatcacattatgacaacaggtgtgaagtgtgtctaccaggaaagctcattagagacttagggaccaaggtttttgttgggggctggttatataggcaacctctctgccttgcctgtacccaaattccagattctcagaaggtaagcaggtgtttagcataaaccacactatttgtacaaatatttaggcacagtgagtcactcttaccagttctaggaatggtaggaaccctcctgaaatcttaagttctcagatgccagccaagagtcaaccttgcaggcaggtcttctaactttctaattttaacttttctctgcacggttatgttcatttcaaatatcttctcctaatctgtgtttatattgtcttttgctcatccagcagtaatatctgtctttttcaacgctttataattttaatatcatgcaaaaaaatccttgcctaccccattcataaaggtagctccttatatctttctctaataattttaacacattcctttttgtatttaagactgtaacctaactggaggttatttttgtgactggtaaaagatatgaatctcatttatcatttttggcatagaagtagccagttgtttctgcactgtttattgaatggtctatcatatcctcatggatttgtgatgcttcctctggcataccaagttctcctgtttgtgttatctatctctgaactaaattccacaccatttaattgagtttataaatcttaatatttaatagcataaattgtcccctgccttgtcttattgattcttggctcttatgactggcttgtcaagttctgccaaaaatatatatatatggttaatatatattaagattaatgtatatgaatttttctgtcagaattgcttggaatttttagattaatgtaaggataatttacatctttacaaatatctggtcttggcttggcctggtggctcatgcctataatcccagcactttgggaggcagatcacttgagcccaggagtttgagaccagtctgggcaacgtggtaaaaacccgtctctgctaaaaatactactaaaaatacaaaaaattagctggatgtggtggtgcgcatctgtagtcccagctactagggaggctgaggtgggagaatcacctgagcccaggagtttgaggctgcaatgagtcaagattgcacctctgtactccagcctgggcaacaggagtgagaccttgtctcaaaaaaaaaaaaaaaaagaaaaaagaaaattggttttcccatatatgaacatattatatagctcttcattcatgtatgttttctttattacctttcggtaaatgtttatattctccataaagacattaacatgttttgttggaattcttcttaggtactttagggttattatttgttactgtgaatggattgttctttttaaaacttacattttctaattgattgattgctgttgacctgtatgggtttttactattaatgagatatataacaaactgaactcttttattaagtctaataccttgtggatcctcttgaatattccatgtagattatcatgtctgcaattatgactcttttgtcataattgcagataatatgtctgcaattatgactcttttgtcataattgcagataatatgtctctttctttttaatcctaattcctcttattgacttttcttgtcatattcttctagctagggtctctagaaccatgttgaatagaagtaatgatggtgggaatccttgtcagttctaagttttgtaagggactgcttctatcacttagccattaagtatgatgttcactgtgtgatatgggtacacatgctttatcaaggtcaggaaatttttgtcccagtttgctaatattttttaaatttcataaatcagaattgaattttatgaaatgttttctctacatccattgaggtgataatttttttcttaattttttttttttttttttgagacggagtcttgctgtgtcgctcaggctggagtgcagtgacatgatctcggctcactgcaacttccacctcccaggttcaagcagttctcctgtctcagcctcccgagtagctgggactacaggcgcccaccaccaagcccagctaattttgtatttttagtagagatggggtttcaccatattggtcgggctggtctcaaactcctgacctcaggtgatctgcccgccttggcctcccaaagtgctgggattacaggtgtgagctactgggccctgcctcttaatatgttaatgtaggagttacattaagagatttttttagtgttaaatgatttttatattatttgcatcaaagatgctttggtcattattattattttaaaatatattgctggatttgacttgctaacatttcatttggaagtttcacatctgtttgctagtgaatgtggcttataattttcttttcttgcactcccttcatttagtttggtttcagagtgatactagctttaggaaataagttggggtatgtttcctctttttctactctctgaagagtttacgtaagattggattaatacagtttggtaggatttgtctctaaaggcatttggacatggggattattcatgtgtcaattttgaactactaacttaattttttaaaatggttataggacttttcagtttttatatttattcttaaattatatatagattaaaaaattttgttttaaattttcctgtctatagactttgaagtcctgctttttttttttttttttttttttttttgaaacagagtctcgctctgctgcgcaggctggagtgcagtggcgcgatccctgctcactgccagctccacctcccgggttcacgccattctcctgcctcagcctcccgagtagctgggactacaggcgcccgccaccacgcccggctgatttttttgtatttttagtagagatggggtttcaccgtgttagccaggatggtctcgatctcctgacctcgtaatttgcccgcctcggcctcccaaagtgctgggattacaggcgtgagccactgcacccagctgaagtgctgttttttttctttaacattatgggcattttctagatcattcaatatttactgagaagatgacctgtaacgcattgactttagcagtagtttttctttctgattaactttatttctagaattttattaggttgcatatgtcccatggatagggtggcataagtggccgtgctgggcacatggtagacatatagtaatttctgctggatatcgtacccagaactactcaggcgttgtaactttccagagcaaaaaattggaatttcctcatgttttacagggggagggtaaaggcgattctatgaaaattaacaaagggggttgggggaggagggctttcctttttgctaaaggaaaaataacacattcttttcgaatgatgacttatttttgaaaggcatcctggctgaaatgatgagctcaggttttgggtctgagcagttcctattgaaagatacttgtggagatttccaaaagtgcatataagaatggcaggttcttagttctgggggaagagtgactggggaggaaatacgtcttccccttttattgatctcagttacgtgctatgacatcacatgtaattttttgtggagctgttctgatgccccacatgaggcccgtgtcctttgctgccagtgcattccaagagggctgtaccctgggggctatgcaggcagctattcttgtgtgggcttttgccatgcctgtttcaggtttggaactgtatacctttcaggagcatggcttatgacatagcaattccattttcttaacaaaaacgaaccctatttttactttaaaagtaaacattccctctgctgtggtttgaatgtgtccctgaaagttcacatgttggaaacttcatcctccgtaacagtgttaagaggtgagacctttaagaggtgattaggtggtgaggactcgccctcatgaatggattaatgtcattatcttgggaattatcttgggtttctgataaaaagatgaggttagcctccttctcttgctctctcttgttcatgtgatgccctccaccatgttatgacccagcaagaagaccctcaccagatgttggcttcttgatcctggacttcctagtttccagaactgcaaagaaatgagtttttgctctttataaattacccagtccaaggtattgtgttatagcagcgcaacatgggccaacacaccctctatccatctctccaccggccaaaatcaactaagtgtccagcttcattacagccagtgtcctttggaggagaagtctctgaacattcctgttgagattcctgattggagctgtgtgaaacccatttagattgaaatcagaaacatggtcaggttgtgagttttccttttggagagccctcccttattttcacatgctcattctcaaaagcactttgtacatcatgtgatttgtatgttttttgcttggtacgattacacagccctttacaacccactgcccacacatgagctgacccagtggcttcgtgctgtaaaggcagatccagaaggcagtgctgccaggctctcttacaaaaatcagtttgtcttcttttgagatattcctgttctgagagttaaaacaaactcttgaaggcagcagtatattatagatgcaaaatctcacataaaaaccatttaagaaaatctggggacatggaaattgtttttttccctttaacaagatggtaccactaatgtattcttatttttttgcccagagagtagcaatttctaaattgttagacatggttcttctttggtttcacataacccattccttcatggtacttaaagttagtaaatggttgaaatacttccttgagaagtagaaatgaggaagcatgaagagattaaatgagtcacttaaagccactgtaaggaagttttccttcctttttattggtttctgcctttggtgttctgctgcttaccctccctccttcctacctgccttgtgctggaaagggccgggatttgggtatgcccttctcagctgtgtgacttcgaacaagctatttgacgtctcaaggtcttacatttctcatctgtaaaatctaagatccttctcttcaaatggctcccaggtcacccctgctgcagaccaggaatatggctaacattttgggatttgacatcaaatcctgagttgactttacgtaacctgggtccatgacatgtactagctgcaaacaagaagctgatgtgcacattgtctcaggacacctggaagcaaaatgttgaatgttagatttagaagggaccttcatcttccctgagtccaacagccccatcgtccggatgaggaagctgaggccaaggttagcccttgagggctgcagtgctgaggtcctgtgtccttgcccctggccagtgctgctcagccttccccacttttaggagagttggttgactttttgtaagacccaggtgggtataaaccaacaataacattctgagctccccaaccaactgaatggacctctcctctccgcgaagggcattctaaagtcagcctgaaatgctaatccaggcggtgatgggaatgggctgtgggacgtgcctccattacagcctcctccccttggaattcaggcacagctgaccagcattcacattaaaatagagacttcagactgacaaagcggactctttgtagcaatgagataccaacttgacagatagccggccccaaaagaaataaaagtattttgcctcaaaatatatttctttgatgtattttgaaatgtccctgcaaagctgtctcttgtggggaaaatctacattctgtggagaatctccttcccttcccaggtctttttcctgatccagtagagaattaactaagaatctggcactttttgaagtctgataagaaacatttaccatctattctctccaaagcctgctacctggaggcttcatctgcataataagaaccttggtttccataaccccttatcttaacccagacactcccttctattgattccaggtctttagataaactcaaccaattgccaatcagaaagtgtttgaatccacctgtgaccaggaaccccctcagcaatcctctgagttgtcctgcctttcaggaccaaagcaatgtacatcttacatgtattgattgacctcttgtgtttccctacaatgtatacaaccaagctatagcccgaccacttgggcacgcattctcaggatctcctggggctgtgtcacaggccacggtcactcatatttggctcagaataagtctcttcaaacattttacagagtttgactccttttgtttacatgggattgacagatgatatcccctgcctcgagggaatacgtgtgtgggcatctgaaatgtcatctcagctcacctctcaatgagtgggaagagactggaacacttttctccatggtccttgaatttttgtcgttaaacgagttactcttcagggcccgtcgtgtgaaaagctttgctgcacatcagcctggaggaaggctggacaggagaaatagcttcccaccaaagccctcccgtgtctagaagcatcacagtggcccttgcttaggtggcagaggacaggggtagatatttgtgatcaagaaagttggtcaggccgggtgcagtggctcatacccgtaatcccagcactttgggaggccaacgtggacgaatcacttgaggccaggagatcaagaccagcttggccaacatggtgaaaccccatctttactaaaaatacaaaaagtagctgggcatggtggcacatgcctgtaatcccagctactcgggaggctgaggctggagaattgcttgaaccgggaaggcggaggttgcagtgagctgagatcatgccactgcactccagcctggtgacagagtgagactctgtcttaaaaaaaaaaaatgttgctcagaagcttctcgatcttgtcacattctccggtggtgagttgagagcagcccaggcctggggtcctagggagcttgacgtggctactgttctagacagtgctgagtttgtcatcaccttgctttcattatgatttcctcctcctcgtcaccacctacggtgtttatggagttcgctgtacatgaagccccagcgtccagaggtgtaagacagagccccttctaggagctgctgtccatcccactgaaaggcaggtctgacacagaagagacaaacaaccatactgggcctctggggccccgtgagatgtgaacttcaggtaccagagtgcatgcgggaggaggcctgggtgccctggggacccaaagcaggagctcatttctgacctgcctctctcaccaagcttcctttgctgaatgccgtgggcaaacagtggtgttggtattggagcaggatcaaagctcattcctggctaacctgcaaaaatgagcaggtaaacaaatgggatccataaaatagagactaaaatgaaagtttgtcttactgtgattagcaactggcccctttccaaattccacctgctctgcgtggagctgtggcgtctcattccaagagccttctcacagcatctgacccgggcctggggtaacagtacactggggtttgccaaggataaccatagcaaggcagctacaggagcacagcatggtgggggggcatgaaatcagaacaagcaggacccacgggcgggggtgagagcaagtggctgggaggcagaggcagaagtgatggctgctgactcaccgtgtgtctgccaggttgcttaacccatctccgctccggttttcccatgcgtgagccctctgcagtgtgtggcatgctgatcggcctctggcatgaagagtaaaagcaaggccacataaaaatcacaggtgcccctcgcttcgtgcaacatgtgtgccagtccagtttctgcaacagccccccaggcgctgagcctgctccatgggttgggagatgttagacctcaagctgtgcccctagctgggtgggtatgggaagttacatggcagtgctggctgcattctgcttatcactgaaagaagtggctttggaatgggtgatttcttaaggtgtttccccactcagttcttctgttcatttttgtacattattatctcttcattgttgtacatttgttggagcttagccccaacagtgcctgcctaggtggtgcggactgaggaatagagatggagtaatcatgatatccaatgtcttatctcactggcctccccgccccaccacatcccttcccattggacggtgaggactgaggctccatcgctgaaatgcacacgtgttaccaggcagggttgtgagggccagttcaatgaacataaatacccttgtcagatcagttgtcatgattctagagaataaggccggaggaagtgagcatgctgatactaaagaacaggggagagaatactgggtttggttgtgcctggtcactaaaagcaaacttcacccactgagaacctgctagtcaacctcctatgatgttcagaagcctcttgaatgttgataattaatggacagggtgagcttggccaggcaggctggctcatgcctgcagtcccagcactttgggaggtcaaggtgggcagatcgcttgagctcaggagttcaagaccaggctgggccacatggcaaaatgctgtctctggaaaaaatacaaaaaaaattagccagatatggtggcatgcacctgtagtcccagctccttgggagggtgaggcagcaggattgcttaggcccaggaggtcaaggctgcagtgagacaagattgcactgctgcaccccagcatgagtgacagagcgaggtcctgtctcaaaaaaaaaaaaaaaaaaaaaaaggtgagcttttctctactgagtttcttgaagtgtggcacaactgaggcatagcatagtgggacaggatgctgttcatttatctgagaggtgaaaggatgtacctcctgctgcttttttggtgggatggggtcggaggagagcctgatgagccaggcaaggagaggaggtaacagaacactggtggagttgatggtgagaagctggactctctcagtgggctgtttgcctgcccctcccttcatttcccataggcttcggtagaagcgtggcctgcagaatcaggaaacagtgctggttaatctgtaagtatgcaacattcttgggcctttctgtcactgaagagcataatgtaattcaggccagtgcagtactgagatatggagtgtggccagcacccatggcaggtgcttggaggtttatcctagtctttctgctaacttcctggcccaagtgcaggtcacttaccttttctgggattcaggtacctgtaagaagagaagtgagtgtgttggactccctctagggaactggaaggaataagcaataagtatactttgacattttataaatagaacatgtttaatacatgcatttcaacgaggcctataggattaacaactttggaggcatgtgtaccggtttgcggtcagtgctcacaccacctggtggaatttccttcctttgactggcaggaagagggaagtacttctcacacatctgttaccttctgccaagtgtaaatgtcatgctggcatctgtgtcttaattgtattggcattcccttgtactgggcctggatggggtgggtgctcaacccacacagacagaaccaagctcccgactgcagacacacatcattaagtttctggacttcagccacagtatctttgttattagattattaactcaatagccttcttgtcttttagcctaggactctggacatagctctctgtagatgcttattgatgactgattggctaacagatgcaatcacagagtcacagatgtcaactcttgcctgtccttccttcctttccttcccttccttccctccttccttcctctctgtctttctttcttttctttctctctctctctctccttccttccttccctccctctctccctgcttccttccttccttccttcctccgttccttccttccttcctctttctctctttctttctttcttttcttttttgatggagtttcactcttgttgcccaggctggagtgcaatggtgcaatctcggctcaccgcaacctccgtctctcaggttcaagcagttctcctgcctcagcctcccgagtagctgggattacaggcctggctaattttgtatttttagtagagacagggtttctccatgttggtcaggctggtctcgaactcccgacctcaggtgatccgcccaccttggcctcccaaagtgctgggattagaggcatgagccaccgcgcccagcttgttcgcgctcgcttgcttgcttgctttttctttctttctctctctctctctctctctctctctctctctctccctccctccctccctccctctctctccctctctccccctctctccctccctccgtctgtccctctctttctctcgttctctcttttctttctttctctcaagacagggtctagctgtgttgcccaggctggaatgcaatggcgtgatcatagcttactgcagcctctgcctcctgggctcaagtgatcctcccacctcagcctctctatagctaggactacaggcatgcgccaccatgcctggctagtttttgtattttttgtagcgacagggttttgccatgtgcccaggctggcctcagattcctgggctcaagcaatctacccaccttggcctctcaaagtactggggttatagacgtgcgccaccatgcccggctcaacccttgtatttcttgatggttttcacatgcagaagcccaaaatctgggagataccgatggcccctggatccaacactagagttatttctctccacagcagtttgcctcatgctcctttggtcactgataagtgttgttaacatttttcaaatatcctgtctgcactgaggtgtgacgagcacattattacctctgattcccatgctgacacacagatcgggcatgtctttgtgtttgtctttggagagccttatttttctcatgtgatatatacaccgaaatacacaggaatcattattgtacagaacataggagacagccactatgaaagcaactgtccggctgatggaagaaaagttcaggggcttctcattttgattacctgtgattttgctttgcatacaattttatttccttggtgagagctgcttcttccttgctgacttttaagagacattggaagacatggggcgggtcttctgaacatctacctgtgcgtcactttttaatttcttttccaggtagagtctgcagtgagggaatgagttctttttttgtttatttgtttgttttttatttttttttgagatggagtttcgctattgttgctctggctggagtgcaatggcgcgatcttggctcactgcaacccacaccttctggggttcaagcgattctcctgcctcaggctcccgaatagctgggattacaggcatgcacctccacgcctggctaacttttgtattttcaggagggacgtggtttctccatgttggccaggctggtctcaaactcccgacttcaagtgatcctcccacctcggcctcccaaagtgctgggattacaggcgtgagccactgcgcctggccaggaatgagttcttaatgagagactcttgagtctttctctggaagtagaatggaatttttagaaggatgaaagacagatgttcatttcacagagcaggctgctctattcacatgcagcctcaacaccagtgacattccaaccagtgtttagggtttagttagggagagaacttcatccccattagttcatatgtgtgtatgttaaagcacttagaaccatacctggcacataagaaaaattctgtaagtattcattgttcttgttattaccatcatccttgtaattcagtgattcatggcggggtgcagtcaaggagtgtcatgacaagcgaacttcagaagactgcatcagacttacaggtcactgcttttgtagccccagtacggtaggagaaacatccactgggaggtgggtccctcgttagccctgaagagtggattgctgatgccttctgcttcaccctctgcttgtgctccttcttccaagctgttaatttctctgaaatcttgtgtttctttacgcaggggttcacatcctgattgcttgttccactcggaagggaaggcagagggcttgcatctgaagccatgcctccttcatcagtgctgtatcgagctctaggtttgggttcttggcacttcggtgcttcccttctcactcagtagtcataatgttagcacggttgatgcattgacacgctctagtgagcagtttgcaggcatctatcatgaactgttcaaagagatacgcagatacatctcacaaacactgatggaatacttagtatgtgctaggagggcactagggagagaaagatgaaaggcagcgcctgctgttgatttcatttgcatcttgccctcaggactcaggttaattggtctaggagcttatagactattaggcttcctagaccccttgggagacatgggacttgccagacccatttccccaaaaaaggtaagcactgtggaggattcttctcctagagtctagcatccatcatttcaccagtgtggctgattccaaaaaatgcattttgacaagaagagaaacacagttagttaacagacgtcagaatgtgaaataactttggctgattggaggagttaaccggttcttttgtcatcttgtggtccgttctgtgtgtgtctgcttagctttctcacgctgagccttttccctcaggatcttcagcagttttttccagtatgtagatgattcaactcacagatggcagcttctaagttattatgccactgattaaagaattgttaaggcagacttatttctctaaatacaaacacatgcaaaactgagattttgaccaaaactttgctagacacaatagtgtattgtttctctcttcaaagtgtgttccatgatagacttgtgttttataaaacagcagtgcttggcatgtatattacgaggtctatcaccaaagaattctaagctctttttaaaaagacatttttaaggtaaatgaccatttaaaaaagatactccgtctcttctatttttttcctttcttatatcttcagcaacatcctaaatgtgacaatgtacgtaaaacactactgcatagagtgaatgttcactaatgctgatgactgtctttattggtatctctaatagttggatttgtggttaaacatatatgcttcttgccccaaatgactacatctttgttttctgttcgggcaaacagagaactggagttcactgtgatctcttcactgttaacactatttaagtgttattcaaagaaaatggaaacttttggtctcagtgtcatgccaacttgttctagattattgttcttaaaaaaaaaacaaaacaaaaaaaaacagagccccaggctggatgccgtggctcacgcctgtaatcccagcactttgggaggctgagacaggcagatcacaaggtcaggagatcgagaccgtcctggctaacaaggtgaaaccccgtttctactaaaaatacaaaaaatagccaggtgtggtggcgggctcctgtagtcccagctactctagaggctgacgtaggagaatggtgtgaacccaggaggcagagtttgcagagagccgagatcgagcgactgcactccagcctgggggacagagcgagactccgtctcaaaaaaaacaaaaaaaaagagccctggccaggcacggtggctcacgcctgtaatcccagcactttgggaggccgaggcgggcagatcacaaggtcaggagatcgagaccatcctggctaacacggtgaaaccccgtctctactaaaaatacaaaaaaaaattagccaggcgtggtggctggcgcctgtagtcccaggtactcgggaggctgaggcaggagaatggtgtgaacccgggaggcggagctggcagtgagtggagatcttgccactgcattccagtctgggtgacacagtgagactccatctcaaaaaaaaaaaaaaaaaaaaaagttgagaaatacggagagacttattatgaagcaataaatagttatgacacgatgttattaacactgggagaaacaaatagaccgatggaacaaaatagatagctagaaatagacttctacgtaaggaaacttggttatgcagataaacattgtggacaagtgggagaaggaaggattattcaataaatagtgctgagacaacttaaaaatcatattttcaagaggttgcaatgaaggtcctcacatatcctatatacaaaaaattagtttgaagtagaccaaatacatcaatgtgaaaagcaaattctaaacagtttagggaagaatataggaagatattttcatgagtggtgtagagaatgactttttttttttttttttaaagacagggtctcactctgtcacccaggctggagtgtagtggcgtgatcagcgctcactgcagccgtgacctcccaggctcaaatcgtcctcccaagtgatcctcccacctcagctaggactgagactagctggggctgcaggcacacaccaccacacctggctgatttcttttgtattttatacagagatggggttttgccatgttgctcaagctggtttcgaactcctgagctcaagccgtctgcctgccttagtctcccaaagtgctaggattacaggcatgagccaccctgcccgacccaagaatgactttttaaagcataagcaaaaagcataaaccatgaattaatgattgctaaatttgactgtattaaacaaagaatatcagtttatcaaaagacaccataaagtaaaagagatccacaaacttagagaagttatttgcaatatatataactgaaaaaggatttgtatttagagtatgtaaagaactattaaataagaaaaagatactcaaaagaaaatgggcaaaggacttgaacagggattttagagaaaataggaatagttaataaacctatgaaaaggtacctaatcatcagaatttaggaaccccaaattaaagccataatgatataccatttgataccaaccagactggtgaaaatatgagtctgataatattaagtgctgacaagggatattggtcagtggaaattctcatacacagctggcaggactgtaatttggcacaacttttgaaagcaatttattcttacctctattaccacacagttctgccattccactcccaggaacagaccctggtggaaagagaataagctttggagtcagtccaggatttgaatccatcttttaccattttcttttctttctttctttctttctttttttttttgagatggagtctcattctgtcacccacgcggagtgcagtggcgcaatcttggctcactgcaacctccgcttcccgggttcaagcaattccctgcttcagcctcccgattagctgggactacaggcgcctaccaccacgcccggctaatttttgtatttttagtagggacggggtttcaccatcttggtcagcctggtcttgaactcctgaccttgtgatccacctgccttggcctcccaaagtgctgggattacagatgtgagccactgtgcctggcctgttttaccattttctaattgtgtgcccctgagcctatgactttctcagttcccttatctgtacagtgagagaatgttgtgtttagtaactgaaaattcatggcatatagtaaacctcactaaatgcagacacttttattaacatgtgactgaagggcaggccccctgtgggcctggtcttatccttatcctttttagtatatgcacttcttctccacagtgcatatgctaatactaggtattcaagaaagcaaggtttgatttggatttgcagtgtctcccctaaatgctcagctcctgctatatgcatttcattctgcacaaacctcctcgccgcctgccacatctaagctatgatacaaatattcttcacgtgtgaaattccttgctcactgcttttacctcactgtggccatcttctctactaagaaagtcagctgtggtatcaacacacaagaatgtgtgcagctggtagtgtatacattcagaataacaaaggttattacactgaaaggatgtgttttttctttattactgggcatcttaattgcttcttggatgttacaagcccagcattgcgaagtacaccgtagagcagaggactaatctgtggattgagttgaggcacaaccctgtgagtgccctttctcagtgcagcagtctcagaggtaattttactcttttctgaaatctcatttcttattttggtgtgtgcagaaaagctcaactggagttacctgcaaatgcaggcatatgtgatagctctgctcagccacgtattaagccacaagcagccaagaacagatactactggcgacagctaagtaatgcacacacacacacacacacacacacacacacacacacacacacacacacaaaaggagaaaagtgataaagaagcaagaattccaagtgagttacaaactccaaggacttggaacatattctgaggaattcttaaattgaggcttacgagtgagaatatataatgtgtctccttaaacgttttggggtgacagatatttctgggttgtgggtgatatttttagggagctttaaagaatgaattcaggagacttgcagcctgatgctggttgtctgggtattttgggacatttcttatagcccagctttttattgctcaacacagatttagaagcttgtcctaatcaccaggaagatccttaaagactggcaataaagacaggaatttcaggagccaggcacagtgcctcatgcctataatcctagcacttcgggacatgggggtggaaggatcacgtgaacccaggaggttgaggctgcagtgagccatgattgcaccactgcactctaggctgggtgacacagcaggaccccgtctgtaaagaaataataacaggcctggcgcggtggctcatgcctgtaatcccagcactttgggaagccgggccaggtggatcacaaggtcaggagatcgagaccatcctggctaacacagtgaaaccccatctctactaaaaaatacaaaaaaaattagccaggcatggtggcacacgcctgtagtcccagctactcaggaggctgaggcagaattacttgaacccagggggcagatgttgcagtgagccgagatcacaccactggactccagcctgggtgatggagcgagactccatctccaaataataataataataataataataataataataataataataataaagttttttttttaaaaattgggattttagaccaatgtgagggaagttagcagcatggccctgagaagccatgtttccagagtgcactgttaggactgctgaaacagtttaagtacagacatacaagtcagcacacaggaagcagagcccgggaggattagacctgacatttgaaccagtccgagcccctctgtctaggtatctcctccaatcctccagtcatccctggttaaatattttgatttcttttgttaatactgtataataattctaaatctttctgagccaacattaaggtgaccaaacatcctggtttgcatgggacacaggactttcagtgctaaaactgggacagttctgagcaaactgggatgcttggtcctagcggacaactgctttgtgtgtctggtacaggtgagccacagctgtgtatacatgtgtagtgggttgaatagggacccaccaaaaaaggtgtgtccacctagaatctcagaatgtgatctgatttggaataaaggtcttttttataacaatgacaacaacaaaatctaccctttcaactaattttaaagtgtacaatacaatattgttaattatatggacactgttgtacaatagatctctagaaatttttcatcttccataaccaaaatgctgctcccaccgaacggctcctctccccctcctcctcccacccaacggcccctctccccctcctcctcccaccgaacggcccctctccccctcctcctcccacccaacggcccctctccccctcctccctgctctgtggctgccaccattctactttctgctgctttgattttgactacattagctacctcatctaaatagaatcacacagtatttgtattctgggactggcttatttcacttagtataatggcctcaaggttcattcatattgtagtgacaggatttcctttttttgttttttgtttttttgagacggaggttagctctgtcgcccaggctggagtgcagtggtgtgatcttggctcactacaacctccacctcctgggttcaagtgattctcctgcttcagcctcccgagtagctggaattataggcgcctgccaccacgccaagctaatttttgtatttttagtagagatggggtttcactgtgttggccaggctgatctcgaactcctgatctagtgatccatccaccttggcctcccaaagtgctgggattacaagcgtgagccaccgcacctgcccccaccccctgccacctttttttttaaaggctgaataatattccgttgtctgtatagaccacattttctttatccactcatccatcagtggatgttcaggttgttcccactgttttgctatcgtgaacagtgatgcagcgaacatgggaatgcaaatatttctttgagattctgttttcaattctattgaataaatacccagaggtggggttgctagatcacatggtagttctgtttttaattttctgaggaaactccattctgttttgcatagcagcagcattatatattctcatcaacagtgaacaaggatttcagtttctccacatcctaatcaacacttactttctgctgttcttttttcttcttccttctttccttcccttccttcttcctttctcttccctcccttcttcccttccattccttcttcttttcccttccctttcttcttcccttccttcttcctttccctttcctttcttcttcccttccttcttcctttcccttcctttccttctttccttcccttcccttccatcttcccttcccctccttcacttcctttttcctttcccttcccttcctccttcccttcccttccctttttctttcccttccttctttgtttccctttcctttttccttccctttccctttcctttcctttctttttgtgtttctataatcatggccatcctaacaggcatggggtgatacttcattgtggttttgatttgcatttctctgacatttgtgatattgagcatcttttcatatacctgcttgtcatttgtatgttttccttacagaaaggtctatttaggtcctttcctttatgtattttaaaaattggtttatttgcttttgctattgagttgtaggaattccttgtatattttagatatcaatctcttttcagatagatggtttgcatgtattttctcccactgcacaggttaccttttcactctgttgatgctttcctttgctattcagaaggtttttcgtttgatataatctcacttgtctatttttgcttttgttggcatatccaagaaatcattgccaagaccaatgttttgaaactttccccctatgttttcttctaggaggtttgtagtttcaggtctacatttaagtcctttaatccattttgagttgaggtttatgtatgcgtaagataaggatccaatgcttcttttgcatgtgggtatctagttttcctagcaccactttgtgagacaatcctttccccactgtgttgtcttggcacccttgctgaagatcatttctctgtgtatatgtgggtttacttctgatctctctattctgctccactggtctgtgtgtctgtctttatgccaatgtcatactgttttgattacagtagctttgtaagatgtttcgagatcagaaagtgtgaaaattctagctttgttcttttttcttcagattgttttggctattcagggtcctttgtggttggttccatgtgaattttaggactgtttttttctattcttcaaaaaatgccattgggaatttgctaggaatttcattaaatctatgactcacttcaggtactatggacattttaacaatattaagtcttgtaatccatgtacataggatgttgaattttcatatatggactttattatgttgactttttatatatggactttattaagtcttgtaatccatgtacataggatgttgacttttcatatatggactttattatgttgaggcaatttcctttttttcctggtttcttgcagttcttataatgaaaggatgttgaattcagtcaaatgctttttttttttttttacatattttgagatgatcatattatttttatctttcagtcttttaatgtgatgtaccacattgattgacttttgtatattgaaccatctttgcatctctgggataaatcccacttgaccataatatattatctttttaatgtccttttgattcagttttgtattttgttgaaaatttgtgtatctgtattcatcagggatattgggctgtatgtagttttcttttcttgtagtgtctttgactttgttatcactataatgctagcctcaaaaaacaagtttggaagtgttcccttctcttcattttttaaggagagtttgagaaggattggcattaattctttaaatatttggtagagttctccagtgaaaccaccttgtcttagacttttctttttgggagatttttggttactgattcaatcccatttctagtaaaagatctgttcagattttctgtttcatcatgattcagtcttggtagtttgtatatctctaggaatttatccatttcttctaggttatctaatttgttggtatataattgttcactgtggtcttttattaatactttttattctgtggcatcagttgtaatgccccctcttttatttctgattttatttatttggaccttttctccttttttcttagttagtctgcctaagagtttgtcaatttttgccaggtacagtggtgtgtgcctgtagttccagctatttgggatgctgaagcagaaggatcacttgagctcagaagttcaagaccagcctaggcaacatagcaagacccgcccccttcatctctttaaaaaacaaacaaacaaaaaacagatcattaattttgtttttcttttaaaaaaatcaagtcttggtttggttgtttcttttttctattgtttttatattttctatttcatttctttcaattataatctttattataatttccttccatctgctaactttggcttagtttgtttttttctttttctagtttcttcagttataaagttgggttgtttatttgagatctttattcttttttaacataggtgtttactactataaacttctctcctagtattgtttttgctacagctcacaggttttggtgtgttgtattttcatttttgtttgtctcaaggtattttctaaattccccagtgattgttttctttgactcagtggttaagagtgaattgtttcgttttcacatatttgtgaattttccaggttttcttctgctattgattttcagtttcattccattgtggttgaaaaaaatgtggtatgattttaaacttcttaaatctgttaagtcttgttttgtgccttaacatgtgacgtatcctggagaatgttctgtgtgtacttgaaacgaatgtgtattctgctgcttttgggtgaaatgttttataaatgtctgttgggtccctcgatctgtagtgttcttcaagtcctctgttttttttttattagccttttgtttggctgacatactgtactctatacattattgaaagtgggatattgagccaggcacagtggctaacacctgtaatcccagcactttgggaggccgaggtgggcggatcacttgaggtcaggagtttgagaccagcatgggcaacatggtgaaaccctgtctctacttaaaaaaaatacaaaaattagctggatgttgtggcacatgccagtcatctcagctacttgggaggctgaggccagagaatcgcttgaacccaggcagcagagtttgcagtgagccgagatagtgccatggcactcctgcctggggaacagagcgagacttatctcaaaaaaaaaaaaaaaaaaaaaaaaaccccaaaaaacaaaagtgggatattgaaatctcctactattgttgtgttgcttcctatttctcttttcaattctgtccatgttttatatctttgggtctctgatgttggctacatgcatatttataattgttgtatcttcctggtaaattcactcttttatcattaaataatgttgtttctggtttcttgtggcagtttttgtcttaaagtctattttgtgtgatataagtatggtcatccctgctgtcttttggttaccatttacgtagactacctctctttaccctttcattttcagcctatgtgtgtttttaaatccaaaatgagtcccttgtagacagcatatagctgaagcttgtttttaaaatccatttagctactgtatgtcttctgattgagggatttaattcacttacatgaaaagtcattactgataggcaaggacttactattgccattttgctcattgtttttatctaccttgtagctcttttgtccctctcactgtcttcctttttgtttccctcatttttcttctagcaatgttctttgattactttttcattttctgttgtgtatcgcctatagatattttctttgtggttaacatggggattacataaaacattttatagttatattaatctgttctaagctgacaacaacttcagtcacatacaaaatctatatgcttttctgcacactttgttattgatgtcacaaattcatgtttttatgttgtgtatccattaacatattttacataattattttttatacttttgtctttttttaattatactttaagttctgggatacatgtgcagaacctgcaggtttgtttcataggtatacacatgccatggtggtttgctgcacccatcgatccatcatctacattaggtatttatcctaatgctatccctcccctagccccccaccccacaacaggccccggtgtgtgatgttcccctccctgtgtccatatatcctcattattcaactcccacttatgagtgagaacatgcggtgtttggttttctgttcttgtgttagtttgctgagaatgatggtttccagcttcatccatgtccctgcaaaggacatgacatgaatgcacctttttttatggctgcatagtattccatggtgtatatgtgccacattttctttatccagtctatcattgttgggcatttgggttggttccaagtctttgctattgtgaacagtgccgcaataaacatatgtgtgcatgtgtctttatagtagaatgatttataatcctttgggtatatacccagtaaggggattgctgggtcagatgatatttctggttctagatccttgaggaatctttatagtagaatgatttatgatcctttgggtatatacccagtaaggggattgctgggtcagatgatatttctggttctagatccttgaggaattgccacactgtcttccaaaatggttgaactaatttacactcccaccaacagtgtaaaagcattcctatttcttcacatcctctccagcatctattgtttcctgactttttaatgatcgccattctaactggcgtgagatggtatctcattgtagttttggtttgcatttctctaatgacctgaccagtgatgatgagctttttttcatatgtttgttggccacataaatgtcttcttttgagaagtgtctgtttatatcctttgcccactttttgatggagttgtttttttcttcttgtaaatttgtttaaattcattgtagattctggatattagtcctttgtcagatagatacagtgcaaaaattgtctcccattctgtaggttgccttttcactctgatgatagtttcttttgctgtgcagaagctctttagtttaattcgatcccatttgtcaattttggcttttgatgccattgctttggtgttttagtcatgaagtccttgcccatgcctaggtcctgaatggtattgcctaggttttcttctagggattttatggttttaggtcttacgtttaagtctttaatccatcttgagataatttttgtataagatgtaaggaaggggtccagtttcaattttctgcatctggctagccagttttcccaacaccatttattaaatagggaatcctttccccattgcttgtttttgtcaggtttctcaaaagatcagatggttgtatacttttgtcttttaatctgtataccagaattaaaagtgatttaaacactactgttacagtattatagtattctgtatttgtctatatgtttacctttggtagtgaactttatacttttatatgctttcattttcctatctagcatcctttcatttcatcttgaaagactccctttagtaattcttgtaaagtcagtctagtagcaaggaactcctctgcttttggttatttgggaaagtctttattcttggaaagtatccttcgttgacaggtttttattctttcagcactttgaatgtattgtctcacttgcttcttgcatgcaaggtttatgctgtgaagtccactgatagccttttaggggttctattgtatgggaaaatttgcttctcttttgttgctttaaaaattctccctgggccaagcacggtggctcatgcctgtaatcccagcactctgggaggctgaggtgggtggatcacctgaggtcaggagttcaaggccagcctggccaacatgggaaaacctcgactctattaaaaaattagccaggtgtggtagcaggtgtctgtaatcccaactactcaggaggctgaggcaggagaatcacttgaactcgagaggcagaggttgcagtgagttgagattgcacccctgcactccagcctgggcaacagagacttccatcttaaaaaaaaaaaattctccctgaaaagctagaactttgaatacatgctccaactcttttcctccccagggagaagtaaggagttaggggttttctcctgtttattttgtgctgagctagagggcatggactatgacaaataagtacatgctgatctaaaccatttcctttattctcagcatcccttgacctggcgccctttcctattctaaaccatcccttgggcagtccccttgaaaagcctggacattggactatgatccagtctactcttccccgctcccgggagaagcgaggagctggcagtttcctcttgcttacactgtgctgacctgggggagggactatggtgaatggatgccatgaatttccctgccagctttgatcatctggttttgcagcagcctgagatgcaggagcctcttaactggtttccgtatttctcacaaagggaagtagtctatgtatttttgttgaattgctgtctctgtagggacaaagagggtcttgcagttcctattttgccatgttgccgaagtcacttcctggaatgaaggtctttacagatgtaattaaggtaaggatcttgagatgagatcttcttagattagggtggaacctgatttcaatgataagtgtcatgagagacagaaatggaggagacacaaacacagaggagaaggccatgcaaaggtagaggcagagactggaatactatgtttataggccaaggaatgccaaagattgttggccaccagcagacactaggagagaggtgtggaatggatcctctcttaggctctccagaaggaactcactttgctgacacctttgattttggacttttggcctctagaagtatgagagaatgaatttctgttactctaagccagcaggcttgtggtaatttgttacagcagccccagggacatgggaagtgagtttgggagttttactacaaaaatctaggaggaggattttagacctttattggtcaatagccttatctatgtcttcactctctgtgagcccacctgtatctacggctgttatccacataggtgttttgactagggatttctgttcagtgaggtccaaactgccttcctcagtgccctggggcttcctgaaggtgctcttggtgccccctgcaggtgccctgtgggctgctttgtggggagtgtgcgaggtgaaggctgagcctgtgtggctccagacccctggcctcattaaccaaaacaagttttagataagttatttttagggggattaatataggattttgtttgaaaacaaacaaacaaaaaccacttaaaaaaaaagtaaaagaaacgtcctaaaagctacaggttgcattcttgccttctttctcttctaacgtgattctttgtgcagccattttctgccaatgctcttcttgggtgcagcagtgtctgcagtcatggtgactgggaagtgggaagggggcttggagtagaactgcagggaggatgggggttggaagaacccctggtgcatcaggtaaaaccacaaggaggtatgctgccctcattcttatccctgaatatctattgtagcttcttgtcccctttcatggtcaacatcttgcaaataatttcgtcataggctggtatctcaatttcactgacggctcatggcaaagcatggagggaaaaaattaggaaggggtggggtgaagttattaaatactgggagtgagtaaaagtgggcaggcaggaaaattattctaaaagggttaggggaaagggaggtggcataataacaaaaggaagaactgtacctgcattagagtgctataattttccccaagtattgccatagaaatcgcacttcagactctacaccatgcatcaatttgaggagaacaatttacctgtattgtttcccatgtgtcatcagcgtcctctttctcctgtttcagtcagcaggactcatttcatccattttcatctggtactgttgactattcatttctttgcactgattttgctgccaaagtccccttttcaagtcatggacattattaagtataccctttattttacatcacttgccattttcagaactcctttatttcattactttgcattcagaatttccggcctaaatcgatagccttgacataaaggcaggtctctgctttctcttttgggcatgaacagttcctttcctgaatcagaaatttatttttctttctagaagtctagtgtggggaatagtcagcatgcttactaagtcttaatttgttagaaggaaagatgaagataaatattggtgatgggggttccctagaaaataaattctacctactcctaccctcacacgtttacactctgcttttgatgcatctcttgtattctgcttttcctctctaaagaagggaaacttcttcctgggaccagtacattgggctcattagttccagccccagctctgccacacgcttgctgtttagcttttagaaagttagctcatctttctgttttctggcctatgaaatggagactcactgatctcttggatggatgaagtaccaagtaaccactatgggacttgcccccatgcaggagtaatgaatgaatcaatttcaaaacagctggacactaagcccacagcccaggctctcctcagattcattctatttacagcccagctttcacacaacgtgtctgatagccagttccttacgaagcctctgtcatgcttacggagcacgtgaccctcttgaaggagatggggaaggatcatggaatgttaaccactgttcccatgcatggaactgtgctaagaaatgtgctcccaggtagttttggagccatatgtgtctgaaaagaactcataattagctgaagtcaagggaaggggtcttcttatcactccttctgtattgttttaggcactcacactcatcagcagacagagtgcattcactttcttttctttccttttttctttctttttttttttttttttagagaggaggtcttgctttgtcaccccaggctggagtgcagtggtgcaattatagctcactaatgccttaaattcctgggctcaagcaatcctccagcttcagtttgctgagtagctgggactacagacatgcactatcacacggggctaattttgtaaattttttgtagagatgcggttttgccatcttgcccaagctggtcttcaactcctgggctcaagtgatcctcccacctcagcctcccaaaatactgggattacaggcatgagtcaccgtgcccagactacatttactttcttgattgcactttgaggtttaggggctaatgcctgatgctttttttttatctgtatgaagcagcggccacacagatcttcatcaaaagctgactgttctcatttctccccaagtaatcactcttttttttttttagcttgtgctaaatcattttttaaaattgtagctctgaggcattttattatacaaagttagtactcatatacataaactaataggaacttaaaactcattatacctttgcttcattttttttagcttgactccctcgtaaatctttagcttcattgatttggctgctatgtaagcttcattgatttggctgcttaaatcactccgttgagtgatttaagagcataatttagaagaatggtgtgtccatgtgtggctcagtttacagtaccatttggagtttgattgcttctgtgagttgggtgatctctcctcttgaggtccagatcaaccccaggaggagcctagctgctgctccccattgggcgccccatttcagcagaagtagccaggagtcgtcacccagaaccccctaacagcagttagtgtggcatctccacagtggggaatgttgtaggagttattaagaaattattttggccgggtgcggtggctcacgcctgtaatcccagcactttgggaggccgagacgggtggatcatgaggtcaggagattgagaccatcctggctaacacggtgaaacccgtctctactaaaaatacaaaaaatacaaaaaaaaaaaaaaaattagcagggcatagtggcgggcgcctatactcccagttgctcgggaggctgaggcaggagaatggcgtgaacctgggagacagagcttgcagtaagccgagatcgcaccactgcactccagcctgggcaacagagcgagactctgtctcaaaaaaaaaaagaaaagaaattattttaggcagataaagaggaaaaggggtccttgggaagttttcgttttttttttttttttttttttatactttaagttttagggtacatgtgcacgttgtgcaggttagttacatatgtatacatgtgccatgctggtgcgctgcacccattaactcgtcatctagcattaggtatatctcccaatgctatccctcccccctccccctaccccacaacagtccccagagtgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcttctccagcatctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctggtggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttccagggtttttatggttttaggtctaacgtttaagtctttaatccatcttgaattgattttttataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtattaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgactttcttcacagaattggaaaaaactactttaaagttcatatggaaccaaaaaagagcccgcattgccaagtcaatcctaagccaaaagaacaaagctggaggcatcacactacctgacttcaaagttttcgttttttaaagcatctccggaaaagtttctcgtaaagcccagtctcttagagccaggtggcaacctttgatatgcaaatggaagccgttagaaactgggtccacccaaacatggcgattcccacactttcttggcctttccccacctgttcctagcaacatggccgcccccacgtatccccaagtgtgtagaacatcatgtgtcctgcatttgcatattagaaggctagggtgggagggccagctttttccagggctacatcaatgacatgcccaatcaaaccaatcccctaagccctatgcaaatcagacatcgcctcctccagcctctgtatacctagctggtatctggggcaggtgggtttccctgtctccgctttggagcccccgctccctctgtctctatacaggggagcttcttccttctcccttcttgccccttcttgcctattaaactctccgctcctttaaaaaaaaagaaaaagagcataatttgtctgtgagcagcaattattttcccttattggcagtcgggcatacatggagtattaatgctgcttcccattttgtcattttgggttcaaacccacctctgtagtagccaccaccgaaggcagattttggtagactttgaaaaacttgttctgcttgaggctccatgtgcttcatggcttgcaacacctaatggcctgcaaattctacagctacaatggtgagtccagctgctaccacctactagccatggctccagcctggctccccctgccaccacctggagcatggaccatcccagcccagaggtcactgtcaaaaacaacacgcctttaccggagagcaacacagccactgacagcaagctcaatccgcacaagtccaccgacagcaagcccaatctgcccaagcccacccaccgcgagcccaatctgcctaagcccacccaccgcgagcccaatccgcgcaagcccaaccacctcaagcccaatccgcccaagccccgactcatcagttcttcacaccccatatgctttctttttagagtgttgccccctaaaccattcatgatgagtacctttcaccatctgtttttttctttttaccctcttggaaaagaggaaggtcacctgaaggtcaccactggaaaaccttgctggctctggggagttattggtctgtgacactgttcagacttgggctgtaggcagtctggtacctgtgcagcctctcttttatttgtttacttttattgtaaaacctgtgtgcaaaaaagtatatgtagtgtaaagataaggtttaaagaatagtggtgaaaaagaacatccatttaccctccaccaagcttgagaatttttttttttttttgaggcggactctcactctgtcgcccaggctagagtgcactggcacaatcttggttcactgcaacttccgactgctgggttcaagcgattctcctgcctcagcctccggagtagctgggactacaggtgcccaccaccatgcctgggcaatttttgtattattagtagagactgggtttcaccatattggccaggcttgtctcgaactcctgaccttgtgatctgcctgccttggcctcccacagtgctgggattacaggcgtgagccgctgcgcaccgcagcttgagaatatgagcagcacttttgaagtccctacgcaatgcggcttccctcatccctcctttccctctctagcccatcagaggcaaccactgtgctgaatttagtatcaatcaaccccttgatattaatgtagttttttaaccacatattaaatatttaaataatgtattgcttagtcgtgcttccttttgaactttttatcaatggtatatagtatgtatttttctcaacatactgattttctaaatgttacttttaaaaaggtgtatctgtgttgatttagctacagtaattttaaaattaggattcatattccttataattttatctctggggaatttttgaggatcttcttccagaaaggactggggttttatttctccagatacctggagtattattaccagcccaaggcctcctacaaatacattttgggtttttttgaaaacgcaggtggtgtaaattctgactccagccctaaactcaggcaggcatttcttcatttcatttattgcacccagaacaaagtctgagaggggcctgtatcctcagttcatttctgtggggcaggtttttgtttgagtaaacccactgagtgtgttgacctttggggaatcctagtttttgtagagttctctcatttagattcctatacttctaaaaatgtaaagcaaataccaataaaatagcataccagatattggttatcttttgccctaatgtggtgtaacaagtcaccacaaaacttagtgatttaaaataataatttggccgggcgcagtggctcatgcctgtaatcccagcactttgggaggctgaggcgggcggatcacctgaggttgggagttcaagaccagcctgaccaatatggagaaaaccccgtctctaataaaaatacaaaattagccgggcgtggtggcgcatgcctgtaatcccagctgctcaggaggctgaggcacaagaatcacttgaacctgggaggtggaggttgcggtgagcagagatcgtgccactgcactccagcctgggcaacaagagcgcaactctgtctcaaaaaacaaacaaacaagcgaacaaaaacaataatttatttttgctcttgtgtctgggagtcagttagggtctgctggtccaggctgtgctcagctcagcttggtgccccgctgtgggctgggttcagcctgctccacacgtctctcatcctcctcagatccatagagcatgttctcctcatggcagtggcagaatttattccaagagtgcctagcagaaacatgcatgagcagaaacatgcaatgcctcctaaggtctagacctgatgcacttcctttctgcccatgctccgttagctagagccactcatgtggtcctcagtccaataggaaacatattctgcctctagtggaaggagcggcaaagtcacatggcagaaggtctagatacaggtagagaatcttgatcattaattcaatttgccacagggaaattgctttcctttacctctgcttgctagtgctgtggatctgtgctcactgaattccattctcaaacgtttacatttcctgagggtttgatttattactcaagtatgttcatctctactcctgaagtctctcaggtgggatattccagatgagatatttcctaaaattgaaaaaaaaaaaaaaaaaggccaagtgtggtagtggctcatgcctgtaatcccagtactctgggaggccgaggagggaggatcacttgagcccaggagtttgagaccagcctggtgccccactgtgggttgggttcagtctgctccacgtgcaagcaacaaagcaagactccatcactaccaaaaaatttttaaaaatgaaaaataaaaattagccaggtgtggtggtgcgtagttgtaatcccagctacttgggaggctgaggtgggaggattccttgagtccaggatttcaaggctgcagtgagctatatggcaccactgcactccagcctggatgacagagcaagaccctctctctaaaaaaaaaaaaaaaaaggaaaagaaaaaagaaaagaaaaagaacatcaggagaatgccaactcaagaggttcactgcttcccccagctttgctactttggcagggtagggctcctgagaacaggagttcctgtgggagaatcgtttcttacaacttactcatcatacgtcaggatgtcacctggtctctgggggtacctgtggataacctgtggccgggatgggtaggacaaggtaaaacaaaactcaaactcaggtgggtgtggtggctcatgcctgtaatctcagcactttgggaggccagatccacttttgggtggatcacctgagttcaggggtttgagaccagcctggccaacatgtcaaaaccccatctccactaaaaatacaaaaattagccaggtgtgattgtgcacacctgtaatcccagctacccagttgggcgaggcacgagaattgcttgaacctgggaggcggaggttgtagtgagccaagatggcaccactgcactctagcctgggcgacagagtgagaccctgtctaaaaataaaaacaataaaacgtgtcaaactcacacattttaaatattgattcttaagccactgaagaactatatcctcattgtgctgaaaaacaatgggatacaaacttgttctattttcaagacatctagatcttttgttatatttacaagaaagataaattaggtggtggctattcataaattaatgaaagattcctcactttataaaaggagttggtgcaaggtaaatttaagtagcaaacttttccaaaacattaaaaatttcatgcaatttgaaaattttggctgggtgcggtggctcacgcctgtaatcccaacactttgggaggccgagataagcagatcacttgaggtcaggagtctgagaccagcttggccaacatggtgaaaccccatctctactaaaaatacaaaaaattagccagctatggtggcatgtgcctgtaatcccagctgctcgagaagcagagacaggagaatcgcttgaacccaggaggtggaggttgcagtgagccgagatcttgccactgcactccagcctgggcaacacagcaagactctgtctcaaaaaaaacaaaattttttaaaaaattttcttacaacttttcagaaacctgtttatcacatataacaggaaatatttgcaggtctggggctatttttccattgtggtgatcagtatatatttttaatgatttcatttcatttttattaaacttttttttaaggattcatatatggttcatttcgtgtactggttaatgtttgttactttaagccattaaaaagcagaatttgagtcttacaattggacactgtttgcatattgttttagttatttctagttttttgtaaagtatataaatgcgtttttttcttccaaattattggtcggattgtgtaattattaagagcctttgatctgagggtccctgtgtgtctcatctctctctctctttttttttttttttttttcctgtggcggagtttcgctcttgttgcccagactggagtgcaatggcacgatctcggctcaccgcaaccgccacctcctgggttcaagtgatgctcccgcctcagccttccaattagctgggattacaggcatgcgtcaccacgcccggctaattttgtatttttattagagacgggatttctccatattgatcaggctggtctcaaactcccgatctcaggtgatccgcctgccctgacctcccaaagtgctgggattacaggcgtgaggcaccgcgcccggcctgatctctttactgacacgtgcccacaggggagcaaggaattcctaacttcagtagtaacttgggaatttcattgaaaagtgacaactcctttccatctttcatacttatttttcccaccatcttctgggttttgataattatcttttaggtactccaagagtactatgataggcttaaaaaaaaaaagaacagaaaaggagacagctgggaaatccaccagcagaatcaagttccatataccaaattattttttttcatattttcttacatattgtttgtaccatctcttcatcccactctactttcggagcgagcattattcctggaagaacttttgtattttctcggagtccatctgctctgaatacttatctcccacctgaggccatcatgttccattcggagcatcgtaatcattttcacagcaactaaacatgatttcacacacagcagattatgacttctgtggggagtgagcagtgtaaaatgattaaccccttaggacagggaccccatttcacactaatctccttagcaaccaacagaagacaggaaaatggacagcataaatggattgaggataatgcagcatcccatttaacgatcagttctaaatgcctccggaacatacttccaaccagaaatgatagctgatgccaaagagtattgagcaaatgtccctggaaaaggtggcactcgtgtggaagaaggacatgggaacatatgccgtaaagattgggggtccatcagggatgaagtcttgcctgactgtggtgggccgctgggccagtaggactcccggagagacagcatcacagaatgcatggatggtggggttccgaatggcttaagtctaaatgagttgattctacttttgtctagttccgttacgttttggggaagaagagctataccatgcataggtttgtgaattagttcttataacctccctataattacagaaacaaggataacccaaaggtcttgatttttttttcctaaaatatttctttttccctaaaagacttcatggcaattgaataccctgttttcagtttactattgctagttcaaggaagggagtttttactgggaagaagaaagtcaatctaaacaatgccacaactgtttgtttttttttaaataaccttccatgcctatgacacaggcagctaacataatgggttccattgtatttgaatgcttctgaagttaatgctacctttttctgcatgacttacatatagaggaagtcgggttggtttgtagccaatggctgttagatttgatgactaacagtaggtatctcagtaacaaaatgtttctctctccatcaccattaattttggaatcttcaccagagctgattgatcaactcagacaacactctttataaagtataatgaaattagaattttgatttagtcgtaaatgtggttacagggtgggatttgaaagcatcttctgtcattgaagagaagactatcatcaaagaaattaccggcatgctataggaatccaggcattgtggaaccttctgttaccccaggcaattattattattgtgattttcgactcggcaagtgtatggacttgaaaaaatcatctaataaacatttattattagctaccctttgcctgatagcagaaaatgagaaggaaccagatgcacccactttaattaattggtgtaatcaggagtggtatgcgacatcaagggtgaaaattgctgacttaaactgtggctttgtggctccaatgaagtcttgaagtcttttttccccttgaataacaacagaatcagagcctctggattttcctttctcatccatctgaatttctttccttttttgggggtggaggtgtgttcaattgaaacttttgatgtggtgataggattcccaatttttctgcaggagagttgggagtttattcctgagttttctcagttcattcaaaagaccaacaaagagaggaacaacatcaggaaatgtaatggaaacaatacatgttatcctccttttgcctgaacatggtacagattgaagtagcaaccctctgcttagaaaaaccttttctgttgttcccgactaagcaaaccatcctttaggtctctgcttagacatcactttctctgagaagtcttcccaaaataccctccctcccaaaccaccctaccctccatccttcctccagctctgttaggcttccttattcccgtcttagcacttcatccactttattttagaattgcctatttattgtctatatcctcttttacttggggtcaggcactgtgtcttgtcacctctatatctccaggatctaatacagagcctagcattcagtaggtgcttaatcaaacctttattgaatgaatgaatgaatgaatgaatgaatgaatggaagtagtgtctgtctcacctaggtataccttactcatgtctgcattttcagtacctactgtcactggaaaggagttccgatccagactccatgagagggttcttggatcttatgcaagaaagaattctagatgagtccataaagtgtaagcaagtttattagagaagtaaagaaacaaaagtatggctactgcacagacagatcagaaccgagggttgctggttgcccacttttatggttattttttcatgatatgctaaacaaggggtggattattcatgcctcccctttttagaccatgtagggtaacttcctgatgttgccatggcatttgtaaactgtcatggtgctggtgggagtgtagcagtgaggacgaccagaggtcactctcgtggccatcttggttttggtaggatttggccggcttctttactgcaacctgttttatcggcagggtgtttatgacctgtatcttgtgccaacctcctgtctcatcctgtgattaagaatgcagcccagcaggtcacagcctcattttacccagctcctattcaagatggagttgctctggttcaaatgcctctaaccctacttggtgtatcagttatctattgctgcataacaaaccactgcaaaacttagtgtcttaaaacagcagctatttagccatgattctgcagactagcagtttaggctggcccagctggtcagtgctggtttcagctgggctccctcatgtgtctgtggtcagcttccaggccgttgagtgctgggtgttctaagtaggcctcagctgggggtgttgtctcttttccctgtgatcttttatcttccagaaggctagcctgggctttttcaagtggcaactgggcagggctgtaagaaagggagcagaagtatgcatgacctcttgaggcccaggctcaactggcacatcatcacttctgctgtattttcttggctgcagaagtcacagagccagtcctgacttaaagggaaggaaaactgacttctttgagaggaggaactgcaaagataggttttaaagaggcagggatacgtggaggagagtaattgaggacatttttgcaaacaatctattattcttggcatagtgtaggtactctaaagcacttgactactttgagtccaacaagtattagatttagcccaagtcttggaaagtcttccaaagaagataaaatttctctttggttgcattctgaatccctgcccttccccatctcctattccctgatccctccactgctttgtgacccaagcatgcaggccttgtgtggctgtcagcgcccaggtcctcctattcaatgggtgatacatcctggacacctactgttctcctgagcatcttgtataaactagaccccacacccgacgggaccacagcagtgagcaagaaagacagattcctgttctccactgggaaagatggatgtttgactagaaactacgaaatggatgtttgactagaaacaggtaacagaggggacctgccttgttgaggacctggcatttaagctgcgacctaagaggtgggtaggaaggggtgttctcgccatggaggaggtggcggtgacagtgtggggcccagagacggtacggtggagcacttttcagagagagggagtgtgcagaagggccctggtgcaggaaactgggagaggacagaatggcttcagctcaggggtgagggatggcagaggtgtgccagaccgggtctcctggggctgggtgagccaaggcactttcccaagagatgactggaaagctgttgaagggttacagacacaggggaggtgacccaatttactttttaaaatcatcctgggctgcatagataatacatgtagaggcgtgcaaggctggacatgaaattccttccattctccaccatcaaaacactctacccagcggggtgtgaggaagaaagcaatccgatgacatcgaattcgcactaaagttactgagaaccttgtcatggtatttgttcaaatcttgagtgtgcagtcttcgaaaccctctgagctctgttccagactgtcctctcagccttgagtgcacatggggcaccggaagctggtgcactggggaagagagggaaccgtcactgccagctgcccggtggtgcaacccccattcattctgatgtgggctggctggctggcaaggcggcagaggggctcagtgtcgccgtgtaagtcctcaaacggtccttgctagtggctcactttagaggggatggtgcacggctccttttcctcgggatctcagagcaggtgcttcacctgcctctacttcccccttgcccatattccccccattgggtactattttaccttttcattggatgtcatttaaaaaatgtggtaactcagcaacacctttcactgccttaggcatctggttttctgtgtgacacagaggccttccttctggcgctgtctcccgggagcatcttcaggcagcatttctctaacttcactgaatgattctggaagtggctggcagatcactgtcagtggagtcaaccagatgtgtatctgctaggccatttccctttccaccttccctcggttctcgctgggtcacagaagcaatgtcataacaacacagcttcctcctaatgaaacatctgcagccaccctctggctgacagttcattaaccttgtggcccaaactgcttcggtgccgtccctgctcctgaattttaacattcagagttttcttcaaagcccaggtctgcttatcaatcatgttcaatattaggttacttacagaatgaagtcattatctttaatgtttaataactgtgccacaaagataatataataaaatctgagaaatgtaattgagagaggcttttgactcaagtcttgtgtgtgtgtatgtgtgtgtgtgtttaatctttcctaatcctatccccaaggctaagaaaaaccttgttttcgctctgtcttctacttggtttgtctcttttgttttgtttttgcttggcaatgtcctgatcagtctgttttggtgatggctgagtctggggagctggcagcagagatgatgacactgggattgacactatgctgcaggagggggtggttgacggccacaggagatgttgtggggttggacccttgcagggcatggatttggtcaggtatggggaacaaatgaccagcgtggactctgctcctgacacaaatgaacaaagtgcccagatctgattcccccagccctggtggcttccaggtctttgaaggtagaattgagcctcacagcagatggctcctggtagtgaagagattcttgggcaaaagcctggtcattaaagaaggaagatttctttctttccttttttttttttttttggagatggagtttcactcttgttgcctaggctggagtgcaatggcgcaatctccactcaccgcaacttccacctcccgggttcaagcaattctcctgccttagcctcctgagtagctgggattacaggcttgtgccaccatgcccggctaattttgtatttttagtagacatggggtttctccattttggtcaagctggtcttgaacttccaacctcaggtgatctgcccgcctcggcctcccaaagtgctgggattacaggcgtgagctactgcacccagccgatttctttttatttttttgtttaggaaaatgtataaaatggaatgtagtcattttgctttgtcttcttggaagaagcatcaatatgaataagtctttgaatttgcaagttaaaactctgattttccatgggcagaatccgggtgagaaataagtctgtttgactgttttgagttcttcctttaaagaatatagaccatgatggtggcctgtgttgtgtcctgaggggctgtgtacacggagtctatggcaaggttcataaaacgcttagaggtttttcagagaaaggagctatagaaatggaaggtggcacagttgtgttggaaacctcccacggggtctccaggctctcatttccctccaagtcataaagtgagaggatctgtggtaagtctccccctctcccctcccctccctctcttattctgttctcaaggcaagaagcaaagcatgagggtctaactatacaggacaatccttccacggttcctctgcgcagtcccatcttacatctttggaggagttggatagcttttctttcaaaattttacaataattcctttcctttttctgaattgctttatgagttgacttgtcttcctaaggagtcaaagttaacaagactacccttgaacaatgtgaaactcaaccaggtatgtagcaggcttttggttttttatctaaatggttgaatttcttttttggtctagctgtattaggaatagagagaagagaatttctggaagtggagaccaggaaagggttcagactagttcttattattattacttttttttccctgagacagagtcccgctctgttacccaggcttctggagtgcaggggcatgatctcggctcactgcaacctccacctcccgggttcaagcaattctcctgtctcagcttcccgagtagctgggattacaggcacccaccaacagacctggctaatttttgtatttttagtagagatggggtttcacgatgttggccaggctggtctcgaactcctgatctcaagtgatccacctgcctcggcctcccaaagtgctgggattacaggcgtgagccactgtgcccggctgggttcttgagggagccaggctgagttctgcagatgcttctgtttttgactgctctcatattttctaaagtacatcctagtctctttcaactcatggggaaaattgcagagagttagggcccgtatagtatgtgacaccaatcaagacataaataatgaagcataaacatgtttttaaaaaacctgttatttgggatggagagaaaataacccttttcaaacattcgatataactttatacatcctagggaaatgtttacacacaccattggtttaaaattttagctgaattattttgatacttcagttcaacaaatggtcaattcagtcagttttttaattgatttttcacaaaatggaaccggttgactgcttgactcaactagtcatttgtgtgatacagacgcaggcttagaagaataaggttgaactgggcagtggcagatggctaaggtcgagtttaaggaagacacagagaactctacccatgggtccgtatcatgggttcctgtcctcacatccatatcatcagttcatttagtgaatgaaatcataatccctgcctctcaaggtctcatttgatttcacattcagtggcgttttcagtctgtgttgaaagcacatgagatgttgacgcatttgcacacatggtgagccaggaaggaggtgacgagagtgaactgggaagagatcatttgaacattagagatgacgattctgtttactattttcttaagtccttactggaaatattacttttcatggactagaactaattggaagtaagatatcctgtaagtccatttagaaaaaattcttccaactagttctgagcacgctggatttgcctgagaaactctttgggctgcattctgagggtggcttgggtggatttgccttgacttgatggccttgaggaataaggaggcctgaatgggcgtgaaactgtgtttagaacttgagttggcctgacacagctctggttcacacttgaacttatgtggacacttctctgcctctccattattcatctttgtacctcctgcatctagcgtaatgttgaacacatgacagacgttcattagatgttcagagtctggttgtttgccagcctaaaatgcttagagtttattgaattgggttgtacatgctactaggacctatgactttggggaaggaagttttagggttcagcaacctttcacgttttgtctttttttttttcttatgggctaggatatttacccaaggtaaattcagagaacaggggtgcgcagtgttacatatggcattccccacttaggagcaagtgactaatatctgtgttaactgaagtctgtcttctcacaggttctgtgctgaagaaccatctcactggctgacaccccttaataagacattctgaatctccatgattacaagattggagtgtgttcagaaccagaggcaagcagaatagttcagagatgtgggtcgtaatctgagtggggatataagggccccgacacaggtgccaccgggcagctgctggaagtgggtttggagccgcacagtgtgcaccaaggtcagtcctgggtgggggacgtgcagccaaaggaccatccctgcgggattcagactccagatcccctgctttcccatcgccatgggatgcccagaatgttaggaacaaaatccttgctcacgaagtcggcctcacttttccctgcccagctactggcttccacgtcctcgtctttatgaactttccatcatgtgtctagaattccatcccctctgctccctgctgattcatgcccgccattttcctagggagctcagtcaacattcagctcttcaaaaattctttttctggcctcatctcaggactgtacttcattttgtagtttttccacacagaacttgtaagcactcttgaatcatttcatttatgtcccgactttttagctagcacgcttaagagcaacacaggccttgtttttctgtgtatatgctgaagcaagcagaactgacctacccaaacttaatagtatgaactgtgttaatataaattgtcagctctggagattttatttgattctcaaagtaactctgtgaaggccaggcatggtggctcacgcctgtaatcccaacactttgggaggccaaggtgggtggatcaccagaggtcaggagttcaagaccagcctggccaacatggtgaaaccccatctctactaaaaatacaaaaattagccggtcgtggtggcacacacctgtaatcccagctacttgggaggctgaggcaggagaatcgctcaaactcaggaggtagaggttgcaatgagccgagatcacgtcactgcactccagcctgagtgacagagtgagattctgtctcaaaaaataaaaaagagcaatttttattatttccatgtttacagatgatgaaactgaaattcagagaggccaggtgacttaactaaggtcacacagccaagtggaaggcagaggtgggatttgagtctttgctgattccatgtctattattctttctactgccatacactgtctttctggtttgctgattcaataaattttgccttgaaaaattagagtcacaattgtcttttgaaagcctttctttggaggaaatatcctctgagaaactatgattttttagaaaataattggacttagagaaaaggagtaggctctgcctaaggaaaaaatgtattacttagtcctttatcaaacatttatgggtttactctgtactgtgctagttgatgggagtgggactagggtcaaatgaggacatggtttctgtcctccctgaacccatagcctcgtggcttggagatgggacaccatggtggcagatgttgtgtgtgcttgtgaatctgaaagactgatgcctgatgggcatcagtttttgtttgtttgtttgtttgtttgtttttgagacagagtcttgctctgttgcccaggctggagtgcagtggtgtgatgttggctcactgcaacctccacctcccaggttcaagtgattctcctgcctcagcctccaaagtagctgggattacaggctcccaccaccacacccagctgatttttgtatttttagtagagacgggctctcaccatgttggccaggctggtctcaaactcctgacctcaggtgatctgcctgcctcagcctcccaaagtgctgggatgacaggcatgagccaccgcgcccagccctaatgttctaactcataaggaaattttaccttcattcactacgagtaggctcatactatacaaatattagtttctagagtccattgatggatgaagagataaacaaaatgtggtctatgcatacaatggcatattcttcagcgtggagaaagaatgaaagatacgtgctatagcggtaacatgaaccttgaagacattatgccaagtgaaataagctaaacacaaaagcacaaacattgtatggttttgctcatgtgacaggcaaaatcatagagaaagaaagtagaatagaggttgccagcagctagagggagggagaatgggtgccgagtttcagtttgggaaagtgaaaaagttctgggcatggcgattggtgatggttgcaaaacaatgtatgaaccactgcattaatgtacttcatgctcttgaatagtacacctaaaaatggttaaattgataactctcatgttacatataccacacagaaaattagttttcagaatagctgacaagctatgcttagatatgtctttaaggcaggaggaagatggcagtggtcatagcagtgtgtggaaagcaggagagaccccacatgtcaccaattagctctccaaatccagaaaacatcagggatgaacagcctccgctgcccatgatccgcgagctgtttcgctagcattccgaacaattctggcaaaggcggaaacactggaccaggatctgggtgactctttcacagttgattgggtaaggagaagcgctgttctcagagaaatgagaacatgtgtcttggaaggctgcctttgcttaatgttctacacgatccaggaggccagatggcattttatgtggttttcacaactgtgattttggattgattactaaacctgtttgtgttcctaacccagctcgctgcctcccgcctgccttttagcttaacgctcattcccagagctcagtttgaacaggcgcattgtttttattctgttccttattattattgcgttggtgccagcctttactaccttcagccctatttgctgcccagagtctagtgcagaaaatgaaatcctttttccaataagtgtgatcaaatgaaaggctgtcacactgcatttacatccaattctgggtttttttttttttttttttttttgagtttgggtcgcccacatgatgggttgtaaaaggataaaggataatttctgatgtcgtgccagcttttcctcacccagctgaccttctactatcagatggtattttcataggaaaggcaaattaattttatatctaatgtaagaaaaacattattaggaagattgtaatgaaaattaagtagtttgcaaaatgttttagaattttcatattacttttgcataaaaaacttctttcagttcttacaacagtcctgagacagagttcagcaggtgtccccatctcatgaggaaacggaggctcagagaagttagggggcatgtccaaggttgcccagctaacattggtcagagctggatctggagagcttatctgcggggtccacatccagaatgctttctaccgttctgctgtaccagctggaaaacaaaatcccattcgagtaaataatatcagcaatagccaccattttaagcaacttaccaggccatttactaaataagtctccttgtactgtagtaactctcatgactaaggtctgcagacgacccatttaataggctggcaaagtgagtcagagattgcgaggagaggctgagagcttcctgggaacatctctgttgatgtcttgaactgggttcccattgttccagcagggaaactgaggatagcagacattgcaaaatgtccttctgtgaagagacttctagtcgttttggtgaaaacacagtgtcctgctgcctagctgaaatcctggtatggataagtttatcttatcatctttctatttctagtacttggcccagatcgtgacctaacagcaactatttgttgagtggaacctccaaagatagcagtttcttcttgtggggaattacagtctattgatttgctcaatgcaagttcattttattaagatttcttcacctgtgtgtttatataaatagacagccaggcagtgcatgaaagtggctgcccggccagagtctggctgggctgcttcgttctactctggggattggacccagtagaattcttggacttggtgtggagtcccaggtcaagccaactcattacttctacctctcctttttaaaaagggttttctgtctttggttcaagttcctcttaaaacacaatcatcatcccttcattgatagaggcacaaatgaattattttttttcttttttcttttttttttttgaggcagagtcttgctctgttgcccaggctatagtacggtggcacgatcttggctcactgcaacctctgcctcccgggttcaagtgattctcctgcctcagcctcctgagtagctgggattacaggtgtacaccaccacacctggctaatttttgtgtttttagtagagacggggtttcgccatattgaccaggctggtctcgagctcctgacctctggtgatccacccgcctcggcttcccaaagtgctgggattacaggtgtgagccaccaagcccggccgaatttttaatttttttattgaaatggagtctcactctgtcacccaggctggagtgcggtgatgctatctcagctcactgcaacctctgcctcctgggttcaagcgattctcctgcctcagccccccagtagctgggattacaggtgcgcaccaccacacctggctaatttttatatttttagtagagatgggggtttcgccatgttgaccaggctggtctcgaactcctgatctcaggtgatccacccgcctcggcctcctgaagtgctgggattagaggcgtgagccaccacgctcggccgaggcacaaatgaatttaaacctcattgaaatgacagcggatggccatggctctactgtggtttccctgggccactttcttctcccgccttcctgccgcatgcaggagtggaggccgaggctccctggccaggctgctctgggttattacagtgatatatcttggaactgagcttgagcagggatcctcctgtttcctgttggaattgattttctgtccaactttcatttcctattgtgcattcctttggggtcagagcagctttctcagacaaaagcagggctttctgttttggagatattcctggcgtctcttcagctgcgtgtttatagaaatggacagcccggcagtgcatgaaagtggctgcctggccaaagtctggccgggctgcttagtggtactctgggggttggacccagtaggattcttggacttggcgcggagtcccagatcaccctgtcattggccctgtatcttaacttgtaggcacgtcttcatctgtcagatgggctttgttctctgaagcccgcatcagagagctcttcagaagagaggaaatgttatattgctgttatcatttcaaatgcttaccgctaagtgaatctggttcaaagcttaacagcctgtgggtgaaccgcaaaagctcaattggatctcaaagaaatccctggtcaagccctgtgccttctagtacccaattatttatcaataagtgtgaagattgcaacctccagattattcagccattgttgagatgtgtaaaaacggtatccccagcaccttgaaaggctaagtaggatcaaccccccagttgttgttcactttctgtgtcctcagaatccacttttgtttcagtccttctaacccattctcattgttttctgtcagtgttggaataagtggaatagcagggtccataaactctaccacttgattgtcaggaatgaagaatttggttttctctgttgtcataacattcgtgagtacatctgtaagcaggcattttcccatcatctttcccgcatttctaatgaatgtgacatcagtctatttgctgcttcataatcaaggtcctgtttgttgatatgtaatcaaagcaaccggattatgtttgtcagtacgagtcagaaaaatctaatatatatttactctgatgccataaggagtgtcagcctttgctggcctcaataatctcgtcttgggagagaaagctcataatgtggtgaagataccgttttgggattatttctagaacgtgatagttgtgccgtgcacatacatgtccaaatgcattgagtcatgtgatagcatccagttttatgcaaccaaaattggacattatattgtttggatagagtgctcaagatgggtggttcctggatagagtgttgaaggcagtggtgccatcaattcagcagcaaggaacttaatagctttctcatcacagtcctcacctcctccctcctttttctgtgtcacagaagcagtaagaaacatcgaggaatttcccaacatatcagggaatttgttatttcttctaaaacataaggaagtacgtggcaatataaatggcaaatgtgcggggtgcggtggctcacacctgtaatcccagcactttgggaggccaaggtgggcggaccaagaggtcagcagtttgagaccagcctgcccaacatggtgaaaccctgtctctactaaaaatacgaaaattagctgggcgtggtggcgggtgcctgtaatctcagctactcaggaagctgaggcaggagaatcgcttgaaccttgggggcggaggttgcagtgagccaagatcgtgccattgtactccagcctgggcaatagagcaagactctgtctcaaaaaaaaaaaaaaaaaaaaaaaaagaaagaaatggcaaatggacatttacatggtgattagaaaattagaatacaccgggaaatctgggttctgttctcagtcctacttgtaacacatccactgaccttaaacacatttctttactttgctgcacctgaattcccttatctgctgtaaaatgaatttgttgaactaaactaaatgttctttttttttttttttttttgcgacggagtctcgctttgtcgcccaggccggagtgcagtggcgcgatctcggctcactgcaagctccgcctcccgggttcacgccattctcctgcctcagcctcccgagtagctgggactacaggtgcccgccaccacgcccggctaattttttgtatttttagtagagacggggtttcaccgtgttagccaggatggtctcgatctcctgacctcgtgatccgcccgcctcggcctcccaaagtgctgggattacaggcgtaagccaccgcgcccggccctaaatgttcttaaagatcctttccagccctgacattgaactcagtacatcaacttacatgatttattcgcacaatcttagcagaattaatttggatttgttaattgtttgcatctggctaattattgcctgcacaccgtaagactatctaacagtagtagtttcttatattaactaaaggtgctgtgaaggaaacatggaattcccccaaaatcaaaactaaaagaaacttctgctttagagcaaacactgataaaatatacataaggcaccctagctgcactgggcccttctgccctcttcagcaagtcctgcctgaggtgcacacaattattactggctcttgtgccacaaagtgacatcgtctttggctgtgacaccacatgaagagggaaggaggtgtgagactgtgaagacactcagtacaggtgcagcctcctccacagagtaaatgtgatacttctcgagttaatgactatgttgggaagttttccaactccaccatcttccctgcttcaacgaggatcccagggggaagctcacagatttgcagatctttttacactaaggaagaataaagcagcattccagttgcaggagtataagccagccacagacccagggggcacatcttacactgtctttgggagaaagaaaaagtactaataacaaataaatctgatgggatttcagatggattccagtctcattcttttgtgatagcagggagtgaggttttgatatattccctctagagatggttctaaacatggagacccatcgatatccaggtatacctcctctcctctctgatcaatccaattgctaaacaagaccagagcaaggctcagtagttgatggcaagtgcttctgctaattgccttgcgattggggaatcaggaggatgtttttattcaggaaggcatgtctgaccaatgaaacaaaatgcagttggtatcattttagatttggctcttgaatcgtcagaaatatgtgccttcactaactttgaggaggaagtatcccttctctttgggtatctctgggaagttgctttattgatttttcaccagtttgcagacaagcccaagtctaaaaaaaattcagatgtagcctaatactgcaagcctttcttttatctgtctatctatccatctgcctgtctgcctgtctgcctgtccatccatccatacgtccatccctccatccatccatccatccatccatccgtctacctacatgcctgcctacctcagcctcccggatgtttgaggctgcagtgagctatgatcacaccactgcagtccaaactgagtgattcatgattgcaccactggactccagaccaagtgacagaacgagacagacccatctttaaaaaaaaaaatgattatgagaggtctcagtgcagaaatggcttcctcctgcccattgtgccagcttgcccaggcccagaggttgagtcatgatatgaatgtgctgtgtagtgtccagcaccagaagtgtgggtatagtggaggaaaaagatacagagccagaaccaggacatggaaacatttttaagctatatgtttttaaaaatcaccacccccatgctagagagaggactgaattaggtttctgttttctctctaaaattgatataacaaaattgttgtcatgtgaagagaaaatcaaagagtatgctgacaaaatatgtgggaaaatctaaagcacagggacaaacgaaaaaaatagatgacttgggactatatcaaaatggaaagctttttttgttgcaaatggtaccatccagaaaatgacaaaagcaacccacagaatgggagaaaatttttgcaaatcacatatttgataaagaacctgtacccagaatatatgaaagactcttgccactcaataataaaaagacaagtcaattataaaaatgagtaaaagatttgaatagacatttctccaaagaagatatacagatggccaataaacacatgaaaagataattcagcagcattagctatcagggaaacacaagtcaaaactacaatgagatacccctcatttatactcgcatggctagaataaaaaagataaacaatatgaagtgttgatgaggatgtggagaaattgaatccttatacattgctgttgaaaatgtgaaatgaggccggtcgcagtggctcacgcctgtaatcccagcactttgggaggccgaggcaggtggatcacgaggtcaggagatcgagaccatcctggctaacatggtgaaaccccgtctctactaaaaatacaaaaaattagccgggtgtggtggcgggcgcctgtagtcccagctactcgggagactgaggcagaagaatggcttgaacccggtaggcagagctttagtgagccgagatcgcaccactgcactccagcctgggtgacagagcgagacgactcctcaaaaaaaaaaaaaaaaaaaaagaaaagaaaatgtgaaacgatatagcccctgtggaagagaacttggcactttctcagagagttaaacacaatgttatcatatgacccaacaattctacccttgttatgaaaaaacatgtatccacaaaaccttgtacatgaatgtttatagcaacattattcataatagcccccaaatagaaacaacccaaatgtctatcaactgaagaatggataaacaaaatgtggcatgatctatataatggaatattacttggcagtgaaaaggaatgaagtgtggttcattcattgaaatattatggtaagtgaaagaacctagacacaaaagatgacatattgtatgattcctttgatataaagtgtctagaagaggcaaatctgtagatacagtatgtagattcctcattctcaggggctgaattgggacgttgcagctaatgcatatggaatttattttaggagataatgaaaatgttctaaattcgatgatggttgcacaaccctgtaaatatactaaaaagcatagaattgtacaatataaatggatgaattatatttcaatagagctgttttaaaaatattgaaaaccagagatacctgtctgtgctctaaaatgtatccactgccttctagatacagtctaaactctgcagcttggcttttaaagccttttatttatatggaatcctccccaccccccaccatctatacatttgtaaaccttacatgttattcaaatgccataattcgtcaaactggatatgttttctccttccagaaagatattccttcatccctcttataagccttagcactgtctgccttgcgttatatttatttctgtatctgtcatatgatctctatctgatcgagagctctttaaggccgggatgtcggcttgctcatattggcatccttcaggacacctgacccctaaacttatctgattggtacgtgatacatttttatcactggatagaatgaatgggttgtgaaattattagatgtgatcccagataggatactgtttttactaatctctttcacaagggtctttcaagaacaatgcaggatcaaacttataaagagatttttgaaactctcaaaactctgtgcagggtattattattatctgtaatcctggtaactattcaaattagtgtcaattaacttttggctgcactcttaagattctttatcatctacattagtttgtcagatgaggtaatgcactttttctgggtacagttgtctttgaagagattggcagcgtttcatagttgtaaacaaaaccgtctcatatgccggaccgtgacaaagagggactaggacgccagaagctctgtgaaaacacttaaatccatttcagcgaggaggaattgtgatctggtaaataaattagtgttctgctctgttccttggctcctctgctaatgaatgggccccagagatttttttttgtcttgggtgataagcccctaatatctattcaagttcagcataaagctcattttctctagaaatctttgtttaaaaacagaatttttccagtaaatatatttatcaaattaaaagtatttcagatacacagagagtgatataacaaacaaaccaccgcctgtgtctaacaaatgctggctttttgtcatatctgctttggatgtttttttagttgaaaaacatttcgaagatagttgaatcattcctttccttcccaaatctcattgcccctccctccctttcctctgaagccacaattatctctaccaggaatctctctctctcttttttttttttttttgagacggagtctcgctctgtcgcccaggctggagtgcggtggcgcgatctgggctcactgcaagctccgcctcccgggttcacgcaattctcctgcctcagcctcccaagtagctgggactacaggtgcccgccaccacgcccggctaattttttgtatttttagtggagacggggttttaccatgttggccaggtctaccaggaatctttaactggttaatctttcagtccaactttgatatcaattgttaactcttgagaccattttctatttcaaaactgtccatctgactcgtttctattactctgaaataatagaatctcagaattctgtgatctaccttcaagccgattaaatgggaatttttcccagagagagtttaaaccggcctctgggttaggggagaagtatagaccccaaagacccttacagagaaatacttgtcatcacgctcctggaattctgggagagggagaggcatgagaaggctgtgtggccttgtctttgaaatacagaagtttggtgacgcctggaacattttttacatgacaaatatggtgaaatttaacaggctatcaaagtgcagatcaggccaactgaatagcagttttggggaaaatgacaaggtgctaggtagtggagagaggaagattaaataacctacttgggtctatgtgctcgtgaagacacgctcatatgtcttccttgcatggatacctgccttgctctaaaataaacttgaagtgtgtttttaaaaaaagcatgtgtgcagcctgggtaacatagtgagaccttgcttctacaaaatacaaaataaaaagagtagccgggcatggtagcgtgcacctgtagtcccagctacatgggaggcggaggcgggaggatcacctgagctgaggaggttgagtttgaggctgcagtgagctgtgattgcaccacttcaccctggcctgggcaacagaataagaccctgtctcaaaacaagacaaaacaaaaacatgaatggaacaagaaagaatcatgaggtgaggaaatgaaggttaagggaagatgaggatcagagggagtaacaggttcagttctaagatgaggtccgcatgtggaatacataccattaggcacgaagctcgggctggaagtaccctacagactgcaccatgagcttctcaacagacagtgggtaaaggagtcagtgacagaatctagggcttttaagataaaagcaaaccagttggccaaggaagaatggctatttccagcacagatgcctgagggccattttttctgaggatgtggctctcacccttgatggacaatcaggacattctagcaaatgtgcattgtgctctagaggggtgtgtgcagggagcatagctgagggatggaggggctcatgtgcatcaggattgcctggaataccagggattattagtgccaataatgctgtcaatgacgttgtgatggttaattttctgtgtcaacttgactgggccgcgggatgcccagatatttggtcaaacgttgttcttgggtgtgtctgtgaacaaatagccctcactggtgcaggtgagtctcatccaatcggtcgaaggcctgagtagaactggccttcccgtgagtcagatggaagtcctcttgcctgactgctcgatctgggacatgctgctttgggactccagctgaaacatcagttcttcctgggtctcaaggctgccagcctttgggatggaatgacgccatcgggtctcctggttctcagccctttggactaccactgggactgtggtgatagtctctcttgggtcgccagctggccaactgcagatcttgggatctgtcattctccatcttatgataaatcaataaatacctctctcattatatatataatatataatatgaaataaattaataaatatctctcactatatatagtgatatatatatattaggtatattttatatatatgtatatcctattagtcctgtttctccagagaactctggcgaatacagacattccatatgcaaagagaggccgcgtggtcttaggtactagttgtaaaattataatatatattatattatatataatatttaatatatataataaatcaataaatatatatctcactatatatatctcttactatatatataaatcaataaatatctctctctcactatatgtatatatatcctattagtcctgtttctccagagaactctggccaatacaaacactccatatgcaaagagaggtcacgtgatcttaggtactagttgtaacattataatatatattatatataatatttattttatataataaatcaataaatatatatctcactatatataaatatctctcactatatatacatatcaatcaataaatatctctctctcactatatgtatatatatatatcctattagttctgtttctccagagaaccctggcaaatacaaacattccatatgccaagagagatagcgtggtcttaggtactagttgtacaattattttacatttgaagaggtaaacctttgggttcataggctttctaactgatgtcatggagtggtgggagggttttgttttcccttatccattaactttattcttaaaataacaatatcactaataacatttatggcatacttgtaagcacttcacatatattctctcacttagcatcatgacaatattctaaggggactgaggcactcagagcttaggaaactcgttcaaggtcacctagctaggaaacgatgtgctgttttcaaggccctcatctgaataaaactatcttccctttactctcagcggtgaaaatgggggagagatctgtattggaagctcattcagatgttgccttcttttgcactcgaaggctttgctctctgaaggcaggaagcagcaggcacgtgtgcagggaaggctgtgtatgtggcatgtgcaggcagcagcagcaacgcgggacgatggggagagagcccaggggagggaggatgcctgcagaagcggctgtgatgtgtgggaagccccgctgggccggcactgtggaaaggtgacctgcagagccacagctgcaaatgaaccactaattttcccatctctgcttgcaatttacaaagcactttcctggtgtcatgagtagctcccaagtatcagagcagggattgaaacttaagttgtttgacgctacactctgatttcctcaccccacctcactgtcttgccagttccaactgtacccctcaggaatttctatcaggagtctgtgtcaacatcagcatgaagctgaagaaggagaaaggaaatggggcaacaaagcacacagatgttcctaaaaagcaaaagcggaagagagaagctagactcgcctgtctctggtttttctcaccgcctgattgttcctttcagatgacccgcatctctcggagctgacctcagctcagcaagggtgcctgtgacccatggagcagtggccactatctctgcattgtgggagggtggtccgtgttgggtctgcagggtcgttgtcacagcgatgaatgtgtagatctgtgcttgctgaagctcaggctggtcgctgtcttgtcatcgtctcctgttacacagctttcaggctgcttttttggggaagttagactcgcctgctcttttttggggaagttccacctcactgcagccgggtatggtggtttgctcctgtagtcctagctacttgggaggctgaggcaggaggattgcttgagccaggagttcgaggctgcagtgagcagagatcacaccactgcactccagcttgggtgacagagtgagaccctgtctctaaaataaaataaaataaaaataataaataaataaataaatcaccccttggccaggcgcagtggctcatgcctgtaatcccagcactttgggaggccaaggtgggtggatcacctgaggtcaggagttcgagaccagcctgggcaacatggggaaaccctgtctctaccaaaagtacaaaaattagcctggtgtggcaggcgcctgtaatctcagctactcaggaggctgaggcaggagaacggcttgaacccaggagacagaggttgcagtgagccgagatcatgccattgcactgcagcctgggcgacagagcaagactccatctcagaaaaagaaacaaaaaaatcaccgtttaactcagaatcagccacgctgaattgaggtgaggttttatgcatatcagattgaagacctcctccggggagtggtaggctgatggcttagtcatcctataaagagcccagcatctgactgcacagctgggtctacctacagcatggagatggctatctgggaataatgggcactagaattggaggatcctgatgaaccacttcctggccccttgcttgtgccacctcccttcccgccaggtaaatattgcttagacacccagcttctgattaaagccacatgatggaacttgtcctaaggatgcaactgatggcccgtgtcagcttgttggagttaaaaaatatattttaatttgtttagctctctggggaaattatctgagcctgcatgtgataatcaactttcacatgagctttcaagagacctgaaatgatttgagcaacaaaatgagatttttaatctacataaatacaggagtcgtttgcctctctttttgtgtgtatgcgagaggaggggagcttaaaacaattctaattcattccttttcttctcccctaggacactcattagcaatggtaggaaaatggtcacaggagtggtaccttgcctcacattctcacacacattttccctttggactttaaacttcacatcaactcttaaggtgggggtgggcggtagcaagtgttgcttcccctttttatggaaaaaagtaggtctcagagaggttacgtgacatgcccaagttcatgtgctggtgggttgcagagtcagttctagagcccagttctttttggaaactggatcaatgctctttctacctcaccagctgtctcatattaatactagagatactaatgcaaaaacactaccataatagtatctgcaagagaacaaattcaagggaagatggatggatactggccgggcgccgtggctcaggactgtaatcccagcactttgggaggctgaggcgggcagatcacgaggtcaagagatcgagaccatcctggccaacctggtgagacccgtctctactaaaaatacaaaaattagccaggcgtggtggtgcgcacctgtagtcccagctactcgggaggctgaggcaggagaatcgcttgaacctgggaggcagaggttgcagtgagccaagatcatgacactgcacttcagcctcggcgacagagtgagactccatctcaaaaaacaaacaaacaaacaaacaaacaaaaagatggattgacactgcacctgcctgcatcagccaggctaagctgggttaagttgtggctacaccagatgtctatggcttcactggtttatgcaaagtcccctgtggggccaggtcactctccagggaagatctcatgacttccatgtcagcaggacttagggtgcactgaagagggaaagcagactgaagagctttgtcgaaagggtgtttaagtttggcagcccaaaaatgacagagaagttcatagccagtcacagcctgtgggctggctctaattgtgcagccctgcccgatgcacgggcggttgtgaaactgtgtcttccgagtgtgtaagaaggggagaagacccggaaatactggtgaccactagccatgagcaccacatggtctgcaggtctgagcggtcaaaagatctgttctgtggagcaggctcccctttaaccatgtccctgtcacagatcccgcggcaagcattcacaccacctggaattaatcgggaagaaagtcgcagtgtttagcagatatttcacagatataaactgtgcggtcttcctaagtctctgcacatgatcagctgaagattgggcttcttgtggtgcacataccattttcgtcattaaatccccaatgactcaccttgtcctgaaactgttaaagctccttagcaagactgaggcccatcctgatttgggccccgacaccctccccagtctcttctttcatggcacccctcctgtcatctgggtttgtgaagctcctttcagtcctctcaaaagagcgtttctctcttccccctctcgctctccgcacctgctgttccctccgctttgaggtatttcctcctcactcacgtccctctttgtccaggtctcaggaggcctgctcttgtatgtgagtccctagctagatggcaaaccccttggggtcagagacagggactcctggcagcacttgcccttaaaaacttatattcaggcggggggcggtgactcacacttgtaatcccagcactttgggaggcctaggcaggtggatcgcctgaggtcaggagcttgagaccagcctggccaacatggtgaaaccccatctctactaaaaatacaaaaaaaaattagccaggcgtggtggtgggcgcctggaatcccagctactcgggaggccgaggcaggagaatcgcttgaaccccagagggagaggttgcagtgagtcgagatcgtgccactgcactccagcctgggcgacagagcgagactctgtctcgaaaaaaagaaaaagcaaacaaacaaacagcccttacattcagcatagggcttagctaatacatggaagcaactgactactatgtgttcaataagcaaatgaatggtcgtgtgaatggataaatgaggtctgtgaagttgaatgcttgtctgggtgaggggacgtctcctggctcaccctcacctctgttggctgtgctgcaagctgtagtcaggatggtcattttccagctttgaccatgattgctcttgcttttggtgtcagcgcctacctgtatggtgccctccattcgtcagttgccttatatcccagcacgcttcctcaagagctgaagaaacgtcttacattttcatatgaaatcattttcaagcaaggtatagattcacataatacataattaatggtaaaatgctattagcattatgtacttaaattatttggctttaaggccaggcgcggtggctcacgcctgtaatcccagcactttgggaggccgaggcgggtggatcacctgaggtcgggagttggagaccggcctgaccaacatggagaaaccccgtctctactaaaaatacaaaattagctgggtgtggtggcgggcgcctgtaatcccagctactcgggaggctgaggcaggagaattgcttgaacccaggaggtggaggttgcggtgagccgagattgtgccactgcactccagcctgggcaacgagagcaaaactccatctcaaaaaaataataaaaataaaaataaattatttggctataatccccattggagttactgtttaatgggtagagagtttcagtctgagttgatgaaaacgctctggagatggatggtggcaacagttgcacaaaaatgtgaatgtacctaatgccactgagacccacacttcaaaatggttcaaggtacattgcttgagcctaggagtttgagaccaggctgggcgacagagtgagaccttgtctgtaaaagaaaaaaaaaggccgggtgcagtggctcatgcctgtaatcccagcactttgggaggcctaggcaggtggatcacctgaggtcaggagttcaagaccagcctggccaatgtggtgaaaccccgtctctactaaaaatacacaaattagctggacatggtggcgggcacctgtaatcccagctacttgggaggctaaggcaggagactctcctgaactcaggaggcggaggttgcagtgagccaagattgcaccactgcactccagcctgggtgacagagtgcaaaaaaaaaaaaaaaagaaaaagaaaaatatcagtcgggtgtggtggtgcacgtcgtggtcccagatactcaagaggctgctgacgtgggaggattacttgagccccgtagatggaggctgcagtaagccgtgatggtgccactgcactgcagcctgggcaacagatgagagagtaaaaaatggttcaaatggcaaattttatggatacttcgccacaataaaaataaatttctattaaagtacatatcattaattccacaaatgcaaatagaataccaatcaaaggaagtcctcagaacacagactgcacagtaaagtgtgggcctaactagaccacagcctgtttcatgtcaccaggcttagtggatgaccgcactgcaaggaaaattgctgagactgagtcatgttttggttctctggctgcttctattttttttttttttagatggagtttcattcttgttgcccaggatagagtgcagtggtgtgaacctccgcctcccaggttcaagcgattctcctgcctcagcctcccaagtagatgggattacaggcacccgccaccatgcctggctaatttttttgtatttttagtagagatggggcctcaccatgttggccaggttggtcttgaactcctgaccccaggtgatccgcctgcctcggtctcccaaagttctgggattacaggcatgagccaccgcgtccggcccctgggtgcttcttattttggaaaattcttccccaaatgagactaattttggctcagtagaaaaattctctcacctcttgtcccgaaggtgaaaatccacctcaatgattttcaatttttttttaatcatcatcggcctcttttattttttttctgatagaatgtgctttaagagatagttgtagcctgtttcctattcctgcatttataaagtaacaattcatttatccttgccagctgtctgcaagcttaaaatacctagacacatctcaccacccagtagtgtccttgactggcttggatggccagtttccctatactgatttggtacaattgctacattttatagaatacttaaatatgaatacaagtgtgatttctgtggggcttttgacaaaccagaactagttcaaggaccctcacaatcaccttcaagggacaaaaacctgcattttgtgtgtttcctggtgcgtttcctttaagagtcctggcgcctgggctgtccagcccgggtggagggactcccgagacctggtgatggatgctgtagtcaggagtgcatattggatctgttacacggtggtgatatacgatttcaacatttcagggttgatttggattttctgtactccctgcctggaattttcctgctgtgttgttttgtgctttactgttcaacaagaggaaaataaatctagaaacctgcttaaaaatagacatcctgttttcaattctctatcattaaaagatcttaaaagctagaatttagttctcttcccggtagaaggaaggagttgcgctaaggtcccttcttagaaattagctctagaaatcctaaaattctagctaaccaaccacagtgttcacgggcctaatatcccttacatttttcttgtctgacaggcccagagggctcactgtctgtgagctttcacggggttgttgctatcccccagggttgattgatctgtttattctaagcttgaggccagagctggaagggaggccgtttgttttgggcactgctgagaaaaacagactaatcacctaaataccaccttggggaatgaagttacttgaaaagaaactgaatggagcctgggcttttatttggaatgaggaggcaaacctgggaagctgcatgccgctgaatgatgatgaaaagcacaaagctactgaatgcctctggcttggccgccaaagagaattggtttctgtaagtgtcggagagggaagacccgcattccagagctgcacccctttcttcacatttccggtccctctcccccagctcctgcacaccctgatgctggaccaaggggcctgggcagaggtgggtgtgctgggcgggaaagtacgtcatggatgcctcaacttgccatggatggcaggttgacttccttcccagcaacttgcagatgttcagatgcgcagagttaaggtctaaaacaagaaaagtttgctaacgtagagtggccgctgggtcttatctttccgtcttcaatggccttgaaaaatatggggcacgcatggggatttcacactcttaacaagctaatgtctctaacactacaggttacacttcacctgatttccaggttagtgcagcgcctgacctctctccagaggcaccctcgtttagaagcatagatgatgcaaaaacatggtttctcttctcagttcagattgcctctgttgcaaggactgagaactctgaggagatctaggagatccctaagtatattaggttttaattctgggtcaaatcagcaaatgtttattaagtacacacaacagacagggcactgtaagacaaaacaaatcaatcagtcaacgtcaactcttgtcattgcttggggggtaaaggcaatacaaggaatgactggcaaatacaggtgtgaattccacttaccctcagcaagacgagggaagaagaagattctggaaagggagaattctgccagcaccaacctgatcatccttctgggcatggccaaatgcctccatttttcctctgaggggcttctttgccctgaggaatatacaagttgatagggctacttgccttcttgctcattaatatctgcttggctccggatctgcaggtagagcagtgctggaattatcccagagctgtgttgtgacctctggatgctagcctttccaagcagggactttgctgcgactccctaagttcatagggaaagcagcaaggatgagttcgggagactctggcatatgcatcagagttccagagtgaaaggtggctctgaaaactttgcaaactgtacataactcaattccccaggctgctgtgtgtccgtcatccctgaaatttcatgaggccagagtaggtcaacaggggctaatgagacaagatctaactaaacagagtaaagagtttctcggtcacaagggaaacttttactatttgaaatcagcctgagccaagattgatgaggaaaaaaaaacaaaaaccaaaatctactgcattttactcctatttaggaagaagtaaacttttgtaaacaggaagaacacagggatatttgctcttagctagaatggggcaaattggcaacagttttgggtgcctacggctttgggtttgatggagtcaacctgccactaaggaaatagacccaaggaggttaaactcagtagagagctatgggtattcctttcctttaagttacagctcccaggaaagcaaaacacaagctgaacaaacattatacaagccatgtatatgtgtagcatgtgtccagatccaattcacttatttgctcacgcttctaggaactccatccttgtgcttttatctcctgggctctctgactttgagacttttcacagctgtcatcatttagcataaataacagcctgcggaagagtgggtgacaatgtggcattttgctgggccacttcttgctcagcatttgtcgtggagtcttctgccattggccatgtgccaggcctgacaaacagccatcaacacaacttgtcaccaagtgattttgaaaacttattgttgaggtgacttcattcttacatctttcgtgcttggcaaagtaattactacgccaagttttttttttttttaatcaaaataaaacactgattaaatgttttcctgtatctggattacaaactattccgtgatctccaaactttgtcctctcgtgtgtgtgtgcatctcacacaatctctgtccttcttggaaaaatgtctccattaattactggggatgaaagttgattaaaattgtaggtcatttcccagggaggttttatgtgaataactttagtactgtgatgcactacttatgaaatctctggtctctttctaaaatcaggttggagaagaagagactgtgcatgacagtgcagccatgtggcttggagactatgtgagtggaagcattttgaggatacgatttctgagtccatgctatttctctgttgtagcttagctgtggattccttacgtgcgaatgatttgggagtataagaacacagactcagtgtcatcattttgtctaccattaccctttcctttagaaaatctgtttgtgtcattcatttagaatgttgccgttaacaaagtattttatgtatactattttatttggacattatgatggtccacgctgtgaggtcagccagctattgttcatatttgttccagatgagagactggaggttcagagcagcaatgtgccctgcacacctccacacagttcacacagtgctcagaacagcaatgtgccgtgcacaccacacaccctgttcagtgcagaggcagcaggcaggaccccaggacttctgagtcctgatccaaagctacttcctcaaaatccctttactactttattattattattttttaaatagactttttaaaaagcagttttcagcttatagaaaaaaagtgaatgaaaagtacagaattcccatgtgccgcctctcgttctcctcagtttcccctgttattagcatcttgccttagtgtgctacgtttgtttcaactgatgacccaatattgatacgttattgttaactaaagtttatagtttatgttagggttcactctttgtcttgtacattgtatgagttttgacaaatgaataaagacccagtgatcatgatcaagtgtgatttccccaaagtgagatgtgttgtccttcacagagcacacttagtgcagtggcggtcaatctaactggttttttttgttgttgtttttgttttgttttatttatttatttattttggtggcttagtctcctctgtcacccaggctggagtgcaatggtgtgatcttggctcactgcaacctccgcctcccaagttcaagcaattctcctgcctcagccttctgagtagctgggattacagacacacgccaccatgcccggctaatatttgtatttttagtagagatggggtttcattgtatcggtcaggctggtcttgaactcttgatttcaggtgatctccccgcgtcgtcctcccaaagtgctgggattacaggcgtaagccaccgtacctggcctgtgtttttcaaatgtaaacaaaaggccatcaagcagtgacagttcatctcctgacttcatttttattgtcacaaaagtgttctggttagaaagaaaaaaaatcacatatccaccattacagtatcacacagagtcgtttcactaccctaaagccccctgttctctctctattcatccttcccaccatccaccctcatccctggcagccagtggtctttttctgtctgcacagttgtgccttttctagaatgtcagatagttgtaaccatgtactgtgcctttaccaccatgttgagccttgatgtgtttccttcgttggttttatcaataacaacgaacattcactggtttctttccatcgaagttacattttttcatgaaggtaaactcttaaacaagtgtctctttttgtcaccctctcctaggcctattcttgctattggttagaatgtggccaatagattcacctcatggtagcaatgtccttgctgaatataacaaatctgatggttgtcatctaccaagaattttgtttctctgaggaaaatcagcaaaactctcatttcagttctagtgtagcctagccatgctaggctgttttgtaaatgatgactattaggagatatttgtatccattgagatggagaacaccgaagcttcgaaggaggaaacagcttgcccaagtaaagaccattaggagaacacaaaataaccaccaaggcttccttattcccatttgagatgctgctgattgagccgcaattggccagtgctctaaaaccgaggcctggaaaggacaggccatgccagttcgctcagccattcaacccagcagccctgactattgtagccaaggtgatggacttgattcccatagaaagcagcatcaccttggagctcacctttaactcctggaggctggcagggcccctgtggccacaactagactgtgagaggaaccaagaaagtacgttgagatcttggaaccaacccaaatgcccatcaatgatagactggataaagaaaatgtggcacatatacaccatggaatactatgcagccatagaaaagaatgagttcatgttctttgcagggacatggatgaagctggaaaccatcattctcaacaaactaacacaggaacaaaaaaaccaaacaccgcatgttctcgctcataagtaggagttgaacaatgagaacacatggacacagggaggagaacatcacacaccggggcctgtgggggatgggggataaggggagggagagcattaggacaaatacctaatgcatgcggggcttaaaacctagatgacgggttgataggtgcagcaaaccaccatggcacatgtatacctatgtaacaaacctgcatgttctgcacatgtatctgagaacttacagtataataaataaataaataaaaatcacacacaaaaaggaaagtacatttagatctcatctccctctcaccccaaatccaagaacagaacaactcagacacatgtcctacagatcagcacacaatttttttgtgattgaagaaacgaatactaacattggttgatggaagagacagtactctaaagtcagcatgataatggacagaagaacaaatgatgcatctagtaactgatgtttaacaactgattacctgtttgtatggcatatttaaacattattgtgttttctgctgtttgggtagtggttgtttataattattaaagatgccccgagtgacaaagagacgaaggatcatgaacatcttaaaacacttcttgctttttaacaagggcagagcaaagttgttaaaaaggtaaccgagggtcagataaccaatgattcattgatgatgaatgctcattcttctagtgccaatgtggtaaaatgtggatgtttttaaccttgtaagttaggtggcagcatagtctagtagaaaacacctctagctcatggatgaacgtttctccaatttgctcccaagtctcttattgatactatatttgggtgaccctgggcaagtcctattgatagttggctttgacttaggacaaatgaggttacacagactgagagttttgtgttggacttcaagtacgcttctagactaaaagcattatgccattaatatttatgttatatagcttgtatataagtatctctattcctattatcttattaatgttcacatgtatggatgtgtatacacgcatggatttgtgtagatatgtgtggttgtgacgtatgtattttgtgtcttacagttttgcaaagctcttttgcagacattacctcatttgatctttcaacagtctctcagaagggggatgtccttgctttcattttataaatgtggttgagagaggttatggttcctgaaacttgatacaattaccaagtttctgaaatataggaaaaataacttcattgtagacaaaggtcacaatttcaagaggctttgtaacgaaattatgaacaagtttggaaaaactgcaagaaattcattgaacaaaattaagaagatcagccttttgagaaaggtctctcttgatggcaagaccgagcagcatctttcactgagccacagatttgtatggcggattggatttctggggaaggttctcctcagaacagtgcccttcagtccaccggaaagtgccactccaatttttagttaagaaaggctctgaaaagacccactctcaaaggtaccacctgttcatgtagtcattaatttgttaactaattaatcgacccatctatttattcgcttattcactcaaaagcatttaccaagctcctactgtgtgtcctcaaggacatccagctgtacgggaataaacaggggaagcatatggtggacttgaaggtggagttggtgtggaccctgccgtgggtggatggaggtggaggtggggtggtcctgccatgggtggatggaggtggaggtggggtagacccttatgtgggtggtgggaggtggaggtggggtgggccctgccatgggtggtgagaggtagagttggtgtggactctgccaggggtggttggaggtggaggtggggtggaccctgatgtgggtggttggaggtggaggtggggtgggccctgccatgggtggtgagaggtagagttggtgtggactctgccaggggtggttggaggtggaggtggggtggaccctgatgtgggtgattggaggtggaggtggggtgggctctgccatgcatggttggaggtggagttgatgtgggttctgcacagcttaggctgagcaggaagtgtattttcagacctggaatagactccctatggtggacagagttgctggaaaaaatatcagaatatattgtttaggacatctcatcttcaagacatagattccccttcttatggaattttgagatgtcctagctggaggaagaagaattctttccatggaaacaataaacagtcaaaatgtttactatgaaattcatggaaatgctctgccagaggctcgggaatctctgcagagaacattttctgtactgcaggatgacagaggctgtcgagaataaaatgaagctgagtgcttgtggttgggattccttctttttcctcttttattgtttctccttagctttgtgcccaggtcatttgtctatcttccttcccttgaaatccctcctgctttggggccctgcactgcctctggagcatccagttctgagattccaatcacagggccaggcatgaaacacggccatccctcaggcacacggctgctgggatatggcaagcttgttaacacggcaggacaacccaagatgccatgttcctaaagaaaatgggggccgggcacggtggctcatgcctgtaatcccagcactctgggaggtcgaggtgggcggattacctgaggtcaggagttcgagaccagcctggccaacatggtgaaatcccgtctctacttaaaatacaaaaattagccaggtgtggtggcatgcacctgtaatcccacctactcaggaggctgaggcaggagaatcgcttgaacccaggaggcggagcttgcagtgagtcaagatcacgccactgcactccagcctggacgacaaagccagaccttgtctcaaaaaaaaaaaaaaaaagaaaaaaagaaaaaagaaagaaaatgatattcattgcccacctccttacacacatacccagagtggagttaatcctttccatatctgtgtacccatgcttctttatatatattaagttgaaccatatgaaattgccaggattcacgatcttgacctgcaaaaataggcagtttcatgtagttgcacctgctatgtgtggcatttgttctcactttcaccgtgagcgtcatttgttgactttagcttaaaaccaaccttattccactgcatgccaccttgtcctcagagaattcataaagacaggcttaagaatccatttcagctgggcgcggtggctcacgccagtaatcccagcactttggaaagccgaggcaggcagatcacctgaggtctgagttcgagaccagcctgaccaacatggtgaaaccccgtctctactacaagtacaaaattagcgggcgtggtggtgcatgcctgtaatcccagctactcaggaggctgaggcaggagaatcgcttgaacccaggaggcagaggttgcggtgagccaagatcgcatcgttgcactccagcctgggcaacaagagtgagactccatttaaaaaaaaaaggaaaaaaaaagaatccatttcatccagccttctgattctaggaataggaacgtcaattcaatccaatgaatcctgggacagcatttggtgtgccaggtagagcgtgtgtggcggagggggggtggtattgtttgtgacgtaggttttctgattggaactactgttgcaggcttgaccatcacctcccactactgcgtgtgaggctaaatgctgctccctcgcttattgctaaatggagagaatacgagggagacaatggggaacgtgaaagcaacaacattgtcaactggatttgatgcagggcagtgggcagggactcagaactccactccccctactcagacgggcaatcatgtcacagtcaagatgagaaatacccatcgagatttgagtgcatgtgactcttctaaaagtaaggcgtgttcttcacagcgcacactgagcaccgttgcagtcaatctaactgatgtttttcaaatgtaaaccaaaggcctcaagcagccacagtttatctcctgacttcctttttattgtcacaaggtgttctgtttagaaagaaaacaagccgttagaatattccaacagaaacagcattaacatgatttactaggtgggttatttagggttactcagccaagaaatggcatttctggacagtggtagatttgttcagcctctcacaaattgagggaagtggctttatttcttcccacccagctagttcccctgtcctcagcccagagattcaaatgccaacggctgccaagtttaccccaggaccgccaggcaaaggttccggaccactgtttgttttccatttctgtggcctcatcatgctcagaaatgctgacttctacgaagagcccagaaaagttcagatgtgtgccaaggctttggttgtaggcttggcacaaggagcagcagctggtaaggaccaggagacagcccggcctcctccatggtgcctgcctctcatagaagcagtcaggaggacaagcttttggtttccgcagacttagcagtcattcctgtgttcctaagaatcatactcgggattttaaaaattcatgtatttagttataactgtgaaatatcatagaaccgggaggtgatgtccaagtcatctggccagtccagtttctccttttgcacatcaaggatcaggccccaagaggccaagggattagtgggaacccttcttcttgccttcacatccatctctcagtctttgtttcctatcgcttacagttgtttttcacttctctcttcttttcctactccttaccatctgaagaactgaaaaaattattccaggttcagcaatgttggaaccaagttttgtaaacggacctaagccttttacaatctgggggaccttctttaggaaatggaacacagatgaccatgtatacatgttgctggcgcccctcctatggctttggaaggcacccaggcaggtgaggagccctgaatctcgagcttcctttagctttacagtgattcagtctctggttaggaccattacgatttctttctttatttcccccttacttatgccctatatgaaatgaaacagatgtgagtgtttgaatcaaaaagacttccctgatgtagtggtctcattttagatgctcagagcatagaataagtggcagcagaccttacttgttccatctggtttttgcatagactgctcgagttgtttttcctttctcatttgttttcctcccttgcattttggtctgtctgctccccaaacttttagctatgaaacatctctagaattcgacatctgtcagaggaggcagcggaagttctttctctgggatccatgagtcctgactcccctgatactgtgtgctgagagagggttttgttttcataattatgacaattcccatgtattgaatgcttcctacatgccagatatttccagagctctgtgtccctggaagagtcaagaaccactgtttatagcattgagaaggaaagagtctagcctctgacatcttttcttctaaaatgactgcaacacatggacatatttttagctattttttccatgaaatgtattttctaatgacttaagacattagatcaatgggaaaagagagcgtttatgtttttatgaaggtaatattttcagtggcaaaatgagctttatcagacctcaggaacttgtgacttccagaaaacaagaatggttctgacctgggatcgtgagaatgtctttatcctagacatgccaatccacacttagccagtgtgaagggaagagtctgcacttagccagcatgaagggaagagtggcagagaggggactatctgagtcctgtcacggcctgtcaggagagtgacaggtgagggtgggcaggaggtctccgaatgaactgctttgctggtaggctgtgtttctgtgtttagctgaggagagggcgggagagagacccaggctgggaggtgggggtgcctgagcctcctgtgccatttggagcatgtcattatgggggagtcacttattttgcaggggggaggggggtcccaggcctaacatttgtaaaattagggaatatgctgggactaagggttcgttgtggcctgcagtctgtttctatttatttattcatactcataaacatagatctctaatataggccaagattttgaaagaattagtagttgcaatttcaccttgtaagactttctcttttaggtaccttatattagttttacttgttagttacccagatatgtcaagcatagagctaaactgaatgcctgtgtatttgctgtaagcattgcctgccttaattcatgctgtgatgtggtgtggtttgcggaattcctagagtggccagtgcaccatgaccaccaactgacactaggctccttctagcaaagaccagggaatgtggtgatgcctttagttggtttataaaggactagcacccatgagcaggaaagggcacgacactcattttggcactgtgaccgccctcctggtcacaacgcctggtctccacactggcagggctgttcttttacaaggagggacacagggtttgagacaggtccagttgtcgctcatcgagaactcgtgaagacagacaggggagcagtgaccctggaaatcagctgggagagtccattcatccacgtagtgagaccgtgtctctgttgcggttcttatgtccacccacattctgtgattcattgtgtgttcttattagtatattataatctattagagggtatttttctctaattttctgtcattttgtagttctgtgcaaaaggcatgaaattgtggattaaaatgagggcatctggatattgctagaaaacaccagctgaattcacaggctcgcaaagaggtcgtatgtttggaaagctttagccattgctgtggttttctattttctggaggtggggacaggataggaggtggaccctagtccctagagactatttccaaagtgtgtttcccagttgggatcaattattgtttgttgacttggtctcaggattgggctgcgttctaactcgagaattgccaggcctcagggaagtgtctgcttttcagggaagtccgcccatcatctgccactaacacaagtcagagggccacggccatcaccagtgctgcaagtgggaagggcagagtggacttacataaacaccgtggcattcctgcctgcagctccggagctccaccctcatcgccactatctctccttggacttgaaccacaggcagatgaggccccaggaattagttgcacctgagagtctggaagtatagcccaaccctccatgtgtggaaggacagggtccagacccctcccgtcctgcttctgcagtggctgaatggctggaggccgccatgacacccctcatacacattcactcactcaccattcactcccactctcctgcccctgcccctttccaggctcccaactctctctctcatgtgtaccttgaaggtttgctagatgatatcatagtagacgctaacgaaatcgttgttaaataaacaatagagtgacatgtatacaatcaataagaccaaaaaaggtgtttaaaaaaatcttttatttttattttttaagagacaggcctcactccgttgtacaggctggagtgcagtggcacaatcactgttcactgcagccttgaactcctaggctcaaattatcctcctcccttagcctcccaagtagctgtgactacagctaccgtgtctggctaattgtgaaattttttggtaaagacagggtcttgctatgttgcccaggctgatcttgaacctctgggctcaaccgatctgaagtgcaaagattacaggagtgagccactgtgcctggcccccaaaaaggattttaatgttaggagctgagttatctgagcagacacagtccactgtctggtcccaaggctccatgtagaattgtctgcttttagcacacaggcccacctgggctggcctgaggaggaaattcaggagtgggagatgccatcttttcctagccaggaggggctgcagagcgtgtgggctgagactcttggggagggggtgtgaggggcagtcacatggcctcatgtgaaattctccataaagaatcccaggcagaaggccatggacaggcaggctggtgcaccgcatgtgtgaagatgagcagcagggacaacgggtgggtggggggagggagtgggggagggagcgggaggactagagggagtgggaggactagggaaagtggaagagggagtggggggagagtggggaaagagtgggggagggagtggggacggagtggggggactgggggaagtgggagagggagtggagggagagtgggggagggagtggagggagagtgggggagggaggagggagggagtgggggagggagagtgggggagggagtaggggggtaatagggggacagtcgggggagagtcggggagggagtgggggaggaaataggggggtaatgggggaagagccgggggagagtcggggagggagtgggggagggagtggtggagggattgggggagggaatagcggggtaatggggggagagtcgggggagagtcggggagggagtgggggtgtcggaggatgtctgatatattcactccttcctttaatgatttcaaatgaagtgctttttttaaaaggcaggctcaccaatgaggtgcgggaagtccccgcagagagagagcccacgtagtaagtaaggaacgggggcggttagagattctggagaggccggatggaaaatgcacacacggtgagcagaaaccatgatcctgagacgctgatgtccaggagggagcctcagagcaggaacgcagccgcggcagggggcggtgggagtctgcggtatgacgtagggtacgaagggcctgggggtggcagagcagagcctgctgcggaggcacaggcttctcattccgcgcgagtgaccgagacatggatcgcgctcttgccggaggagggtgcacgtgcggaccagaggcttcccagcgccacggtgccaagttgtgggggtgctgagccaggagcttcagaagagcctcacaagcagggcacaagctgagaaaaatgacagctcacgacactctttcttcatatttaaaccagaggaccaaacaactcaaggtgctcttaagaaaagcccgcagtcgtccaagactttaaatgaaaacgcggatctgaaaatgggtgaaggaaatttgaggtacccacatttgccagaacatcgcgtccaccctgaagtaaggtgctacctgtggtggacacctttgtgacacttcgtctctaagtgagataggatttccagggagcgtgggactgtccctggattggtggctgctgaggaaggatttattttccatggagctctagttggctgtgagattttaggtcaacaactggctacagatgatagatggagagatagcccctgtacaatattcactgtggactattattatatagtgcatagtaataagacaatgtacaaaatgtgatagcgtacacttctttcgtatgtagaaaatgcagggatttttaaaaagtgagatttactttggtctgaagtcctcatcaggaggccaggcgtggtggctcaggcctgtaatcccagcactttgggaggcgaggtgggcagatcacttgaggtcaggagttcgagactagcctggccaacatggcaaaaccccatctctactataaatacaaaaatcagccgggcgtggtggtgggtgcctgtagtctcagctagtcgggaggctgaggcaggagaatcacttgaatgcaggaaatagagattgcagtgagccaagatggcaccactgcattccagctggggcgacagaacaagactctgtctcgaaataaataaatagcaataaaaaatgaagtcctcatcaggaaatgcagtaagcagatggttatgaactggattacgctgctgcagaccgtcttctaagaccatttgtgtatcagtggttggaggagtgtgtaggccaacctctctttgaactgttgtaaattcattcaggcagatgactaaaaatgacataacccccacccgtctcccaagggggcaggtgagaggtgggtatagcatttcaggtcagaatgggggttctcacaattcatcagtgttcgctccccaaatctggatttacagtctgaaatgttctttctttagcctctgaatgccagaagtaagcacttccttttaatttttatttttccctagcaaattctttagtgagcaagcttttgtctgatctaacctttctctcccctgttggtttcagcctccacctttgtcttgcctttccccccaccacttactcccacccccactgctgacatgttgtgagtcgtctcctggaagccacagccctgctggttttcactcagggtggtgggtcccttatgtgtgtcatgctttgcacaagacagcgaggagtgctggctggtttgctggcgcccagcactatgacctggcttccgttcatggctcataagtttccagtctttggggtatctgtggcttttatgtcatctcactgcctctcctcggcacagggactggctttgctgtcgatggcagacttaaggcaagtgcagaagggaagaggactgctcagaaacatctcctggagacactgtattttcaatgggtctctccaaatccagcagaaaaagggcaaaatgtagggaaggggtgccaacatgaagccatcatggtggtgccaaggatttattgggcagcaagaatcaaaggactggtgggaaagaagaaatcagagtcagcatgcaggagaaaagcagaacggagacagtgtggctggattgatagaatactggaaggcccaacagatagtcccacacccatgttcacagcacattagccacgattagccaaaagagggaagcaacaccagggcctgtcaccgtataaatggataaacgagatgtggtctctacatacaatagaatgttgtttcagccgtaaaaaggaatgaaattcggacacacgctacagcctggatgaaccttgaagacatgatgttaagtcgaatcagccacagtcacaaaagcgcaaatactgtgtgacgccacttaggtgaggcacctagagcagtgaaattcatagagacaaaccagacgaagtagagtggtggtttccaggggctggcgggagaatgggcagtgagtgtttagtgggtgcggagtttcagtttgggaagatgcagagcgttctggaggtgggcggtggtgacggttacacagtcatgtgaatgtacttaatgccatggaactgtacacttaaaaatgattaaaatggtaaatttatgttacatttttacacacacgtgtgtgtgcacatgcttgtaactctccattttttatcttttgatcctaaccttgaacctctccagagccttaacttaaatatctcctcaggccgggtgtggtggctcatacctgtaatcccagcacttcgggaggccgatgccagcggatcacttggggtcaggagtttgagaccagcctggccaacatgctgaaaccccatctctactaaaaatacaaaaattagccaggcatggtggtgggcgcctgtaatgccagctactcgggaggctgaggcacgagaattgcttgaacttgggaggcggaggttgcagtgagctgagatccgcaccactgcactccagcctgggcgacggagtgagactccgtgtcaaaaaaaaaaaaatctcctctacgagtggatgtcgggtgaggtgggctggggtgggcgatttatttggggcttagaaggaagcagaaaagttcagtcatcttctgttacccatacagcaaggtacaagaaacaatgtgtgtgggagcagcaatggcctctctctctttttatttttcagaggaagtggtggtaattccttttagtgtcttgcattctacatgcagctttaaaatctacactgacatgtttcaagcaatctcataggtggctactaacttaatttgtgttttgctcattcctaatgcgcaggaatgttatgaaaatgttcgttcctggtgttaactaactctgttcagtccttgtatcctggttgattaatggcaaggtaattgcccttcatttctttgccttcaaagcagtgccacctaggtctttactgccctcaaaacagatgtcttctgcaaagagtgaaattccgatcagtcagtccctcctcataaaacatgtaggtgagaggccacttggatgcacaggaaggttgcaaagccagctgccctgcaggagccttcagaagagtgacctccatctggggtcagaccccggctccctggagggtcagcagaggagaaggggcatcttctggagaggagtatgggtgcggggcagacaaaggaacagaaacagaaacaatcaagaatgaggagtgagcctgcagtgcaccttagagtgtgtgtctattttctgccaagggtgagatgttctgagcattttctctatgtctacctccgtcaagtactttccataactgctgtcatgtcagcctcctactaaccctgtacagtaggtatgactgccgttccattttcatagatgagaccgaagggtaaagagggtagataactggaccgagtctacacatgtattaggtgtcggagttgggatttgaacccaggtctcatgaccttaagttgggcgagaactggatgtaatctggagtggccagcatgttccgctggggctgtgatttcagttatctgtaagaaagcatgaggcagctaaaaccactgaggcccagcaccagtgcagcatctctgatttccttttgccctgcttgtgtctggggacttcagactgtctgtctgctctctggattctgtggtccaactggcacttctgtgctaaaaatgaaggcataattgaggcatcacggaccccagatgggccctgcagcctggggcaaggctcagctgacctcatggcacccgtctcagtctaatccagtcttggattgccacttcccctttttggctttgccttgtcctcccctggcctggcatcccaggctcctgcttgtggtttacctgtgtgacacacacagacacatatacgcactctagtgccaaacatgacagaccaggaggttggttttcttagcctgagaatctgcatcatctgaatgaggtagaatctggaggagtctggactgtgagggaggaagcttgggaaggagtcaggatgggatgtgctgcccatcaacgcctgcagggaaagaagagtcccacgcagggaaaggagagtcccacgcgggaaaaggagagtgccacgcggggaaaggagagtcccacgaggggaaaggagagtcccacgaggggaaaggggggtcccacgcggggaaagaagggtcccacgcggggaaagaagggtcccacgtggggaaagaagagtcccacgaggggaaaggagggtcccacgcagggagagtcccacgcagggaaaggagagtcccacgcagggaaaggaaggtcccacgcagggaaagaagagccccacgcggagaaggaggagtcccacgaagggaaaggagggtcccacgaagggaaaggagggtcccacgcagggaaagaagagtcccacgcggggagagccccatgcagggaaagagggtcccacgcagggaaaggagagtcccacgcagggaaaggagggtcccacgcagggaaaggagagtcccacgcagggagagtcccacgcagggaaaggagggtcccacgcagggaaaggagagtcccacgcagggaaaggagggtcccacgcagggaaaggagggtcccacgcagggaaagaagagtcccacgcagggagagtcccatgcagggaaagaaggtcccacgcagggaaaggagagtcccacgcagggattgctgttccactctgcatagccgctgggctttctgctgcacggatgccatctagaagaagcaccatccactgttctcagaaagaagagagaggaaggagacaggagtgcgtagagtgagtgggccatcagaaaaaggactgctctggggatgcaggagacccgcttgtaggatttaggggcaccgtgcaagacaggggtcatggtatgcgggtgcctccgactggcggctgcgtggtggatctggccacttggtgaaggtcgcagtgaccttgatctgctctggggagggatgctgttttgcctttcttcacgcacgtggaatcaggactagctggactggcaggaaaaggttctctctggaataatggtttgcttctctgcaggctcgtgcggcggctcgtgcggagccctgtgagcactcattcttgggagagcacctgaagccgcctccaggtttagtcatttcctgctttttcctatacataccttccgtatcaacatgctttttgaccttcctcacctgaatacatctgataccctatgaattcttacctttctttttccaaagtggccaggaactgaaaatgcaacttcattaaactggaaagactggctctttgctaattagtccatttgaaatgaaactaggctaggatttttggttcacctcccagatcacaggaatgtattgcctcattaacagttgaagaagcagttttaaatgatccaagaacaagctgaccacttggattcctgggtagtcggctgggcctcctgtctttctgcaggtttgtgacttacctttgcttccatgggaagaaaggaggcgggaaatgaggtacaaagagaaaattggagtgagtgggcattttggtttatcaagtagaagcaattctgtgtgtatgtttgggaggatgtggagagcatttagaagttttatttatttatttatttatttatttatttatttatttatctatttatttatttttgagaaagtcttgccctgtcacccaggctggagtacagtagtgtgatctcggctcactgcaacctctacctcctgggttcaagtgatcctcctgcttcagcctcccaagtagctgggattacaggcacccccaaccatacctggctaatttttgtattttaagtaggggtggcgggggtcgggggttcaccacattggccaggctggtctcgaactcctgacttcaagtgatccatccacctcggcctcccaaagtgctgggattacatgtgtgagccaccacgcctggccattcatttagcctggtgacctagaagtacttaggaaatgtgtgtgtgtgtgtgtgtgtgtgtgtgtgtgtgtgtgcacccgtgtatgagtatatgtgttttggttttccaatctttggttcacgaatgtagtccatattcttagaactgactcacatataggaattcaataaatatttattgaattaataaataaatgactatggtgtgtgtgtttataggtgcacacacaaacacacacacagagtaacatctcacccataagtcatttatcgagcaaccataagtatttaaaataaatgacaaattagaaagtccagaagaccatgcagtggctgcataaaggtgacaaagctcatgcttgtgtttctttaaaagaaacttatcacccttcgcagccaggtctcctttagatagcgtgcttggccgggagcagatcagaaatggcaaactaaagataaagacaatcacaaaggcaaaaccaacaaagcgacagctaacagcttgacaggaagagaggggacagaaagcagacacagagtctctaagcacagccgtctggtttggggcaaacaactttttgcactttaccgtgcctgtggaaactatgtcatgcggcatggaatgaaattaattaacattcgtagtagacgctgaatcatcaaaagcttgaattatatctcataactttgtaggaagatgaagttactctagcaagattccttcaaaatggtttacttgtttcttaaagagtacaggcttccattatgtacaccaggaggcagaaaactgtggtcagcagaccaaagccagcctgctgcttgtttttgtaaataaagttttattggaaacaaccatgctcattcatttacgtgtttctgatggcaacttcctccttcccctcagcagaactgagtagttgagacagaaaccatatggcctgcagagccaaaaatacttaatggttatttatagcagaagtttgccagtccccaatccagatgttgggttcctcttgaatgttggtttgtgcttatgtatacatctgattcacttgcacgcattaccaagtgatccatatacacgagtgtgaacacatacgcatttctgtgtggtagtaagcacaactaagtgtgagcaccacattctcagacatagctctagaagagagtttctaagaaattagctctgagtcttttctgcttcagtcagctgatggcatggagcagtatgttgtaacctctgacccgaagggcaaaggccttctggaggaagtgtacacccctcagaagcctccctgtacattcaccatccccaaaatagctccttgagtagaggtgcatcgatcacccccaaagcttacataagatcctagcagtcagaaggattcagtgattaggtatcccagactacatagggtcttgtgggatatttcattggtactagaagttgactgcaatggcaagaaaggtatgcttcatagggtagaattttgcttttagggttttttttttttttgagacgtaatctcgctctgtccaggttggagtgcagtagtgctatctcggctcactgccacctccgtgtcctgggttcaagtgattctcctgcctcagcctcctgagtagctaggattacaggcctgtgccaccacgcctggctaatttttttgtatttttagtagagacggggtttcaccatgttggtcaggctggtctcgagctccttacctcgtgatccacctgcctcagcctcccaaagtgctggaattacaggcatgagccaccgcacccggccttttaggctattcttgtggcctttgtcactgacttaatggataaagtttcttctgctaaggcggccatgttggtttattattctgtacggatgtggctgataccacattagtgtgagctttcactagtgctcactttgatagcctccttgcacagcctagctaatatatgtcactggactccattaattttatagtgtcagtagcccagaactcattaaggaagacaagtttctgagattgtagattcctatgggtaaaatatgtatattatcataaaataggtactaaaacgtgatttggatttgggatgtggaagtaagtgccattttattattgagatattcatataccataaaattgacgttttaaagtaatttttagtatagtcacaaaatcatgaatatatattttcaccttgttttaaatataagaagattggttcattttgaagaattctgtgtgacccatatcaaagtagctgttgcagttgtgtagagattcacacatgtatgctctgtcaagatttaccagttggcatgtgtgccataggatttactgagtgtggattatgacagtcctaggtcccttgattttattttatatacatatcaaattgctcttccccattgggccgtgttggagaacaccagggcccagggcccaagcctctagcctaccccaggcccaggggtttgaacaacctccctaccttctggaaacccatttccccccaatactggctggaaggtatgaggagtcgtctttcttactgtccttatcactacaggaaacagggaaagcataagaaaaatgacaaaatgttccagctgagctagagtctcattggagggtacaattgtctctgagtatcagtggaagagtgcctccaggactcctacagaaactaaaatccacaaatgctcaagtccctggtataaaatgtcatggtatttgcgtataacccaggtacgtcctccggtatatctgaaatgatgcctagattacctataatacctaatacaatataaatgctatataaatagttgttattctgtattgtttgaggaataatgacaaggaaaaaaactctgtacgtgttaagtacagacgcaaccatccttttttttttttctgaatacttttaatccatggttgtttgaatccataaatgtggaacccacggatacagatggctgagtatgtactaacatataaatagggctagccttgcttttctgcagcccctgtccctaacatcttattctaagtggccctgggcaaagtgaccattcatttattcactcattcatttgtaggccctactgagagcctacgatgtatacggcaccatgtaccaggccctgagaacacagaggtaagatagacagggtcctgctttcatcgggtttatattccaatgaagataagaggcattcaacaactctttatctaatgagttgtacagcaacccttgtgatatgtgcacttaaagaaatgtgcaggggttttggatagaaaggctcaatgtggagacagacttggtctggaggcggggcagcttctctgagggtgcgacgtttcagccacgatctaagggagggaacagggaaatgcactgcggtcatccaggtgagaaatgatggtggcctcagtgcccaaagtggggacgtcagtggatgcagacagtggatttgagacgtatttaggagatggaattgactagcatcattttattgacacttttcatttctacagtttgagtccatcctcccatcctcctttcccaatcccagtgcctcagatgttctcgtttttcccttggggtgagtctatactgaagccagatggtttcactcaaacccattcagtgctccagagtcaagtgctggtcatcgcaggggagctccggagctgcgtctgtaatgttagtgaccctgatttctaaagggaagtcttcttcagtctgtttctgagattattcctgggagctttaactggaaaagccaagggcttaaaaagatgcagtttttttttttttttttttttttttttttttttttgagacactgtcttgctttgtcacccaggctagcctgcagtggcacagtatggctcaccacagcctcaacctcccagattccagagatcctcccatttcagcctccagagtagctgtggctacaggcacacaccaccactctcagctaattttttaaaaatttttgtagagacaagatctcactaggttgcccgggctggtctcaaactcctgggctcaagtgatcctccccccttggcgtcccaaagtgctgggattccaggagtgagccactgggcccagcacggtgcagtcttcagagaaggtgaactctctgggcacctagagaaacttgtagggaaacaaaagcttgtttataaacttggttcaacacaggagactatgttctccacattgaaaagttccttcatcttttttaaagcatctaaatgatctgtgtctcacttcctaagcaggctggtgggcagggagggtcaccagttggggcagagctcagagggaggtgcacagctgtgcagtgtctaagctcctgcgtctcctgtcacttggttcccgtggcaccatctacgcccatctccctcccccttaagggttagcatgacattgtatcacagggatgttgattttcttttcacttcagttctggattttcaaattctcagaccacataccaagttgaaagcaatcctttgtttcctcttgaaccgtaaaccagaaattgtgcttgggaaaccataccaggtgactaactggaaaacatccccaaaccttgttagtctttggccgtagacatttaattctgagccctggatggatggtgatattaaatacagattgtgcgcacattagtagtagaatgtacccctgaccaatttttcacacatttaaccaagtaaatggcttcttgccttcagtgagtttttatttcaagaccagcaaccattgcaccaagatgaagaagtgagccgcgtggttttctccatccaggggtgcagaaagaaaagtgcagagacagtcttcagtgtttttatataaattcacttttgcaaaaagtatgttgctgtgtaattaagagtgttaatgatgctgcctaaagcatctagggagagcagtctggacaaggagagaatgggaccgtcacccaccggtggctcctccgtctatggcctctagtcattttgctccctacctttcttctgaagtcaattctggtttttgtttttgtttttgttttttccctatttttcccaaagacccggggctggaggcctgtaaagggaccatgctacaatttctgagcaatccagtctggtttaccagaattagaactcagtactgcagaaccctgggaggtgatgatgcaggtcaatgaggccttggcaagaagaaggggagggagggaggatggagacgtcaacctgacataggatttggagaagagtcagagattaagaatttagattaatgtgccaggcgccgtggctcatgcctgtaatcccaacactttgggaggctaaggtggcagatcgcctgaggtcaggagttcaagaccagcctggccaacatggtgaaaccccgtctctgctaaaaatacaaaaattagccgagtgtggtggtgggcgcctgtaattccagctacttgggaggctgaggcaggagaattgctttaagctgggaggcggagcttgcagtgagccgagatcacaccactgcactccagcctgggcaacagagcgagactccatctcaaaaaaaaaaaaaaagaatttagattagtgtttattttggaaagggagagccataaatatatatttcaggtgtctgtcttcactataagtttgtttatggttgaatttgataaatgacttcctttggtctgtggagtgtattagttatttgggtgtgatgtgttggaagaagatagttaatgcatttacaggaggatcatgtgagatttcagatcagggccacctcatgcctttaatacataaaaaccatttaaaacattaaaaagttccatgcaatcttttttttttttcctaccacaatttatgtctttatgaggaatatctccattctgcctctgctctgccagggtaattattatcctgtatacactcaggtctgtgttcaaatcagcataacgaaggctgctatgaaaatgaatatagaattttcataaagttcatgctaaattcttaaactttagcttttacatttttggcagtaggttataggtaggagtcatctttgtaattgacatttaaacgcaatttttcttctcataattgataacgacttcattcgtgccagccgcaaaacccagtgtattattcttgtcagtgcttgacggttttgacaggccagaaaaattgcaagtaaaatagatatatttgggcgtgagatgttgacttataattcatgaagctgcaaccttccacctgtaaaggagaagaattggcagaggtatggttttgatttatgtgttgaaagacagaaaacaaataagaaaacctttgttctgctgtcacaactgatgaaggtaacagtgttaaaaaataatgaaattcacaatacttcctacacatccagtcctctgtagctgcaattcgggggggccaagggcttccttagcagaatctctgggctttcttggggtgcaggtagggctctggccttgctatgctttaactagaactactgtgattttttttccttccttccctccttcctccctgcctcgctgcctccctccctccctcttttctttctttccttctcttttttcctttctttctctccctgtttctctgtctctccttccccctccctgtctccctccctatctctttctttccttttcttttttctctccctgtttctctgtctctcctcccttcctccctctctcctttctttatttttcttccatctcttaatttcattcattcattagccttctgtgtaagattttgtttggaaaaaaaagagtcatatccccctttaaaaacagttcatagaaatgtatcctctagtagtcccagctgctcgggaggctgaggcaggagagtggcgtgaacccggagggcggagcctgcagtgagccgagatcgcgccactgcactccagcctgggtgactgagctagactccgtctcaaaaaaaaaaaaaaaaaaaaaaaaaaaggaaatgtatcctgtacatgaatgtggataatgagctttcctggctggaaaagggcaatcactctggcttctgggatgaccctggagtccttctctgcttcagtaattgccacactcctgggctccgccacttctctattgcccagttcttctgctgggatgctggccttccgccaggcagccttaggttctgcttagacgcacagataatctttaccagtgtgtgagaagcctgaggatacagacagactgcataccgcggccatgtgttgtgtgagtggtatcaggctggacgtatcccttgacaacttgactttttagctcacagttacatttttcggactgatctacgttgattcgtggaaaaacaggtgataccgcttctttccttctatcccccggcttcagttgagttcattctataccccacccgatgcctccgcgtacacactgtagctaattctgcaggagatggagggttccatggtatcttcacacgtggagatggcactacattcgtattctgagctattccccagcagcaagggtaaattttcttctcttgcattctctcgctcagtcaaccttgtgaccattgactcatatttgaatgtcatgtttgggccataggcgcaagtgaggagatgctcacgctggttaccttgcaggtgttttctataatgaagagcccacaagccctcaccccacccctgccctacccgcagctggagtgaaggtggcgccccagaggccactcctgggagaaacctcatcccctccctccttctgcgacttcacagcctcacacacagttgtctgggaaacatcagatctaaccacctcgagccttgcgtctctgtttatgcctctcccaacaggaagctgagactcggaaaatcctcgtccccctccgcacctctctcctactcaccacgcctttccacgggaacacacagcacgttatcagcaaaattccccacaccctcagcgcctttcctgagaggtcctcgtgatggtgtggatctgtgtccctgcccacatctcatgttcagttgtgatcccagcgtgggaggtggggcctggtgggaggtggctggatctcgggggtggtttctcacgaatggctaagcaccgttccccttgctgctgttctcgtgatagtgagtgagttctcgtgagatctggttgtttacaagtgtgtggcgcctccttccttgctctttcttgctcctgctttcacggtgtaaactgcctgctcccactttgccttctgccgcgattggaagctgcctgaggcctccccagaagcagatgccaccatgcttcctggacagcctgtagaaccgtgcgccagtgaaacctctcttcttgtaaattccccagtctcaggtatttctttttctttctttctttctttttttttttttttgagacagagttttaccctgtttcccaggctgaagtgcagtggcatgatctcggctcactgcaacttctgccccctgggttcaagcgattctcctgcctcagcctcccgagtagccgggattacaggcacctgccaccacacctggctaatttttttttgtgtgtgtgtatttttagtagagtcagggtttcaccatcttggccaggctggtcttgaactcctgacctcgtgatccacctgcctcggcctcccaaagtgctgggataacaggcgtgagccaccgcacctggccctcaggtatttttttatagcaatgcaagaacagactaatacagtccctttaccttatcttcctaactgctccccgaagtcctctcaagccacatctgctttgtccccacaccctgaaccaccacgtttggtgctagcgcctcatcactgctccatgatcatccttccctcctcctggagacccctggctttgcatctctggccaccagatcattgttgcagtcatctattcatctctgatccatgccaccttgttccttgtggattgacgctcctggagtgctatcagtacaccaaccctacttgtcagacagtaacacctgtgatttcagtgttcttgtagacaatccttcggtactctggcttctcaggtccttaatctcctcttctccgatgaccttgttcttcactcaacctcagccccccatttccgtaactataccctagagcttattaccggttgtaaagactgataatgcagtcattatctgttatgctccagctccatcatctcatttcaagcatcccattctctgatcaccacctctttcttctctcctaaaaccttgactgaaaacaattcttccacctcactgaagtgcaaaatccatccatcctatcatcttttccccctttctcacctacctcatgtcttcatgtctctcattgtctagtttggagtccttgattatctaatcattaccttgctttactatcttataacattaacttctttacccatctctctcttcatcccactctccttgcaaaactacagccttggtaaaatccagttgcccatgtcctctgtacctgtctgtgcccagctgagcctgggtggaacagaacacagccgtggtgactgtttccagtttatgaccattaacttctagtgggctcgagcaccctctggcagagcgttctcctctttctgtatcatcatttcttctctcttgattgaatcactccttttagcatacaaaaatgctattataactcccaacttaaaaaataaatttctcttaacctcacacatctcattaactactgtcccctttcttttctttctttctttctttctttttttttagagacagggtcttacctgtcacccaggctggagcgtagtggcgtaaccacagctcactgtagccctgtagccttgaactcctgggctcaagtcatcctccttcatcagcctccaaagtagctggtattacaggtgcatgctaccatacccggctaatttttaaattttttttgagagatggggtcttgctacattttccaggctggtcttgaactcccgggctcaagcaatcctcctgtctccccctaaacggatagcaggcgtgagccactgcacttggcctgttccatttctttgattatctttgcagcaaatttatttttaaaatgcgtgtttatactctctgtttccagtttctcatctctatcctctcttgaacccactccatttatcttttagctgccaccactcaatcaaaagctcttatgaaggtcactgatgataatcaagactaaataacatttgtaatagataataattgtaatctgatcattataacacgttcattcattctacaaatatttgttgactggcacctactatgtgccagttactgttctaagtgttttacgtgtattcacttgcttaagccctaaggcgggtaccgttattttccccatgttatgggtgaggaaactgagaaacagagaggttgaagaatttaccttctatgccataagtggtataaaatggtcagttctcagtcctcattttacttgatctatctgcagcatttgcccgtagatcattccctccttcctggatgactttctttgccttgttttctgaacatcactttttgatttctcctttgagctcactacctattccttctcaataccttgtgctggtttcctctcatctgctctaaataaatcgtggaatgatcattcatcagacctttgctctgcctgcactgactccctatgccatccctcccaggcccgtaacttccaatgctatcagtatattattgatttgcaaaattgtatccctagcctggaccttgaccctgaacttgagactgttggtcttagtctgctcaggctgatataaaaaaacaccacagtctgggtggcttataaacgacagaaatgtatgtatttcttacagttctggagactgggaagtccaagaccaaggcaccagcaacttgagtgtctgaggagggccctcttgttcatagatggcacattattgtgttttcacacagtggagggggcgaggaagctctctgggtcccctttctaagagcactaatgtcattcctaatgactccaccctcatgacctgatcaccttccaaaggctttacctccagccatcatgttggggactaggtttcaatatatgaattctgtggggcaacaccacgttcagtttacagcggtctctctggcctcatgtccaaccatctcccctcctcattcatcccactccagccacgccggcctcttgctgttcccagttacgccaactcgcccccacccagtccttcatgtctgcctgctcccctgcctgggtcgcttccccacgatgcctgctgtggctcacagcctcactgccttccggtctctgctccagtgtccctgaatagagtccaactctgagcatgctgtggaaaagggcctcattccaatacacaaagtcccttttcccatgccctgccttactgttctccataggtcacatgtgacgtgacctgtgtgtgcttgtttactggttttgcttcagaagagacctccgtgagagcagggaccttggtttgttcatggctctatcgcacaactgggtataataggtgctcgataaatattctgttgaatgaatcaatgaagttgccacagggaaggcatagacatatgtctttcaaaactccatgtgcttggtctttttaaaagtaaatttctttgattgtaaatagattcacattgatacttgaataaaatcataaaggtatgtcttctttcctcttcctttaagttttaagacacttataaatgtacctgaaattgtaataaaagatcccagaggattttacagcatgttttccgttgatggtaatggatggaaataatttaaataataacattaacaggttgttttactacaggaccacaataattttaaaagacaaacttgaataatcctgttttaccacatccctaaacctatgaaacacacagtactcactcattaatgttgatttgtttaagagaaataaacttcaaaaaaaaaaaaaaaaaaaagccaacaaaactcactctgatattaactgcctcgggtttaaaggttttttcagaatgcctcagtaatactggcttaatgaattaggttctaagaaaaatggccaggcatagttaacaataaatcaggttatactatttgcagaaaaagcaactaaaactctccttgtaaataataatgtggaaagatctggtattaatcaagccactgtctacagctgagctctgttttcagcttctgaacacagtggagttaatattgagcatatctttgtttcaagtataatgaacacaattctgcagtcctttgagaacaggcttttgtgaaaaatcagtaaggaattgcacctaaaacccatttacaagatcatactcccaaaggctttgtcttagagcagtttttaaaatcttgttggtaacctcctgaccacatcattgggagtacaaaaaagtgcagagagtatatatatatatatttttttttcataaatacttgcacatcacatttcccctacggaaattcaaccagcggttccaaagactgctgggctggagttgtccgggttggtggacccgcctgagtctggggtagcttagcttgttcagaggtgtgcacagggctgaggaccttctgtgcgtagcagagtcattcatctggtcaatggccacatgaagacacagatcttgccatatcagattctccttctttctactggaggtctggtgactttacctgtgttagttcaggcacctctggataacttaaggactcaccaagcggcaggtccttatgtagctccacagaccaccatgaaacccttcgaccttttctgaagtctgccttacgtcttgggccactgaacattctgccagtcctgaagaacgtgttgattccagtctcatcccagtgcaaagtgtccttctcatctttgggctgctgtcccctgagcaggaatgccgtccccacagctgatctttgaccatgggtagactctggtctaccatatgacctgggaccatcaaagcccaggttaagctgcatcccaagtgtttttctagccagccatgccctgggggtactttccattttattggtcacggagcactcaggccctgctccaggatcccaggtatggtctctggggaaaactgaccacaggttgtgcaggaggaaccaccagacctgcccgagaggggacatctcttctctttggtctgctgctttgagacaattccaagatcgcagtgtatatatgtgtgaagtcttcatgggtaactatctccaaagcatttaatgattctctttccttggcttataagtaggctgataatggaagttcaaatgatgtgggactctgttggtttgtccttctggaaaatcccactcctcttcctggtcaccaaagcagtgaggggaggagggcaaggaattgactcctcacatgtattctaacaagcatggaacagagcacacaagacatggatcttactgtagaccggggaagacactgagccacttctggctttatctcttctgacctatgcattgggataaacttagctgagcgcgtttccctgtccgcatggagggtctggaaaatgagccggacattgagctgggcttcatactttcatctttgcctctctctagagccaaacaaaggcttacctgggtgggccctttttggtcctgtttttctgtcatcgctgttgatacgtgggccttgagctccctagttgcaaactgggaagtgcattgaatgagaagtgtgtggcttcttccctggctatgccttttcacgtgttaaacatagggaaaactcagctatgccttttcatgtcttaaacaaagagaaaactcagctatgccttttcccgtcttaaacatagggaaaactcagctatgccttttcacgtgttaaacatagggaaaactcagcatttgtaataacatgttatgtttatagagctcttcacaaagtgctttgatgtctgtgattccatttaatctttacatcagcagcaggggataagtgttatcccagtcttactgatgaggaaaccaaggctcaagaagattgaatgatttggccaaggctgtgacactagaaaaggcaaagcttggactaaaacccaggtcttcagaattcaggtccagagctctggccagtctgttgactccttcatcagctcccaagatgaagatgaggagctattttctgttttgagcctttgattacagcttgttttgtaatacaccataaaggttgagaccatgtttgtttctagcacttacaaaaagacctggcccaattagacacttaataagtgttttataaatgaatgaaattagtgagtgaagaggtaaatgaatggatatattgaatgaatagattaactaggcaaaaacctacctgtctgcatttatattggaaagcactacatgaaaaaatgagatttgaaagttttagaatgtggctgtgtgtgtgagagagatcgtccctcaatctttcatttcttctgattgtctatcagtagggaaggtccaagtcccacccatactgtgtttctcaaatattctcaaattgtattgaaacctgtaaccaaaaccaaagttaaaattgattttaaagtgtcttctaggtttttattctaccattcctacctccagttttttgtttgtttgtttgtttgtgttcctttttgagacagagtctcattccttcactcagactggagggcaatggtgcgatctcagctcactgcaacctccgcctcccaggctcaagcaattctcctgcctcagcctcctgagtagctgggattacaggcacccaccaccacacctggctaatttttgtattttcagtagagatgggttttcacaatgttggccaggttggtctcaaactcctaactgaaagtaatccatcaaccttggcctcgccaagtgctgagattataggcgtgaaccactgtgcctggcccacctacttccagtttaaagtcacctgggaaatacttggagtacagttttgtcattttaatccttttttggaccacaacaatcactttacgaacatttttttaactttttcagaatcgattcaaggaaaagtgatagaggcaggtggggacggggaggtgagttttcttcgcatttttgggaatctcaactcctgagcctgtcttactagtacgggttccccaaccccacgactagaactatcttagtggtttcttcctaaagagatgtacacgtgtgtgtgtgtgtgtgtgtggtgggcgtgggtgggtgtgtagagtagggaaaaggtgagaagtggctctcttgctatagacttttgctttttactcttttccactgagtctgctcatattattcatacgattatcacgttagaggttttggagttgtagtggctatcgttttaagtttcttgtagaattaatttatataagtagacaatgtatatgaattgattgattcaaatctgtatcttacaggatctgttaaagatagtcagaaggctgtcttttaaaatgtgaggacaaatcagtttaacagtatagcagagaagtacagctgtgctctgtcaaactctaggctcctgtgtgttggaatgactagaggcagcagggagaggggtcctggtttactcaccccctctccctctttcacatactagcttgggcttgttgtggttgaggtggtgtgggaacatctagaaggttcattcaaaaaagacagcctcagcctttgctcagacgctcaagatgttctgccggctctccctaccatgaaagttctctgagaagccagtaaagatggcagcctctaaagaggttagctttatttggtggaggggcggtaggggtggcacacaccgaggaagattcggatcgtggcacatccttgtggtcaggcccagaaatcctcattgccctgcagccacccaggtcatgattcatgaggtgggggtctaagctgagaatggctggccggttctctgacttcgtgggtgtgtaatagttggttgcaactgacttctcaagaatgacagttactgactggagctggcagagaggtgtggccaagttcctggagaaatgcttcctgctcctcccgccctccccaccaccatcctgctgtatttaaagctgctttggtgatgctttgctcatctcagtgaattttcagttcagaccttttcactaaggatcattatggaagaaagaggggtaagaagtgtggctgagtagcctaggattaattcatcagtccccaaataagcaaacacgatgtctcaggatggacggtgaaattctggacctcacaggtaggtcttggagttgttagttgtgaatgtagacccccaagttcagatgttgccaggattttacatcctctgcttaaggctgtgttgttatttctgatgtttatgagtgaaaacaaaaacatacagctcaggtccttatcctctgagggtctcctcagcctggggcacctcccgccaaacgcttcatgactcccccaccaagcacatcctggcacaatctggcatgaggtctgagctacataaatgtggttttatgagggaacaaagcaagttttggttttctttagaattgtacgaaattataccttcaagatgactttgccttatcgtggcttttgttttgcttctccgagaaggaaactacaaagttaccatgatgtaaatccggccagaggcttgaagtgatttcatagtaaaagccacctcagccgtcccctctgaaacccaggccaagaggcagagatgccaatgacaggctctgtgaccagcctcgtaagccatgaaccagatccacggtttcacatggccaggacctcagggccgcatcagcctcttccaccacactctctcgtgaacagctggtgacactgtcagcggcgcctctgtcacaaggaagggcaatgtcctgtgtagccagatggcgggggagttggaggctgggccaggcggtcaggatctgcattccaccagcccgtggggttttcatagccaggggcactgtgtccaccttgggcgtggccatacacagccaccacttctaaccccattgccagctacaacggaagagagcatgctgtttagagttcagtacctccacataagggaaactgaggtagaggagagccggcattagcttctgggcttagaacacccaccttgccctcctgcatcgagattcatctccagtgagagcaggtgagaaggaatcagaggagagcacctaggcccgggtgtcaaccttgaccccacggacatctaggactggatgatttttattttattttatttatttatttatttttgagacggagtctcgctctgtcacccaggctagagtgcactggcgcgatctcggctcgctgcaacctatgcctttcaggttcaagcgatcctcctgcctcagcctcctgagtggctggggctacaggcacccaccaccacacctggctaattttttgtattttgtttagtagagacagggtctcaccatgttggccaggctggtctcgaactcctgacctcaggtggtccgcccatctcggcctcccaaagtgctgggattacaggcgtgagccactgcgcccggccagtgattcttttttcaggtgctgggatgcggggtgctgctctgtacagtgtatgatgtctagctgcatccctggcctctactcactagacgtcagtagccctctcccagttatgacaaccaaaaatgtctccagatatttcctaatgtcccctgagcatcaaaatcaccatctccagcctgggcaacatggcgaaactccatctctacaaaaaatacaaaaatgagccaggcatggtggtgtgcagctgtagtcccagctatttggaagcctgaggtgggaggaccatttgagcccaggagagtgaggctgcagtgagctgtgatcacgccactgcatttcagcctgggcaacacagtgagaccctgtctcaaaaaaaaaaaaaaaaagaagaagaagaagaaagaatttaaaaaacttaccagcggtcaagaaccattggagtagagagagaatttggtgaaaagacatctgcattctacctttagtctctgggctatgtctccggggctatttatcattgtcttgaattattttgtataataagcagcagcccccacgctcaggtgtttggaggagttgcaattcactgggtggagggtagagcgtctcatgaaatcctcggctcctgtctgaaggccacagctggggtgaggcccttgaatgggagaggcagatgtccctgtctacttcttccttctccctgcctcctcttggccttccttcccatcccctcctctgtgacagcacaccacaccgtcacctgggtgctcgtcagcacgcagattccagagcccggctccccagagattctgatacagggggtctgagaggggacctggaaacctgcctcactgtgagcttcccaagtgactctgcgcagggggcgtggtgaggtcacactttgagaaacaggccctagaggcttttctgaacacacgagccctcccagtactcccaggacactaaagtgtagcagaaacaagcaaaaaaacacaactatactagcaaacgtgacaaaagcaaaaagggataaaaattcctaagaaaggccaggcacagtggctcatgcctgtattcccagcactttgggaggctgaggtgggtggatcacctgaggtcaggagttcgagagcagcctggccaacatggtgaaactccgtctctactaaaagtacaaaaattagctgggcgtggtggcgggcgcctgtgatcccaaggtactggggaggctgaggcaggagaattgcttgaacctaggaggcagaggttgcagtgagccgagattgcaccattgtactccagcctgggtgagagagtgagactctgtctcaaaagaaaaaaaaaattaaaaaattcctaagaaagatgaagctattcaatgtgggaacctctctcactgaaaatggattcatcgagtcattgattgattcgacacatggcttctgtgtgcctacttgacttcaggcattattctaggcatgacgcattccgcagtgaacaacacagacaaatgtgcctgctgtcacctagtttatattttgcagggggagacagacaatgaacggaatgtagttagaaggtggccatgctgtagagagaattaaagcagagaaaggtggttagggagtgttggggctagtttgcagtatcactagatgatccaggaaggcctcgttgaaaaggtgatccttgagaccttgaaggcggtaagagatggccaggcagatatctgcaggtgagagttttctgggcaggaggaacagcaagtacaatgtcactgagctgggagtggacattcctggtgtgttcaaggaacagccagaaggctttcatggctggttcaggctgagtcagggaacaagtgtaggagctgagggcagagagggaccaggaggccgagtcctgcagagcccatggcagggacattgactttgactctgaaggaagtggggcgggggccaggggaggattttaagccgaggactggcaggatcagatttaagattgaaaaggatcaccttgtctgttttcttgagagtggactccaggtgggtaagagtagaagttatcattactattcaaattatggcacggtttctgccccctaggaattcactgtgatggtggagatagaacatgtacagcttaagtaaggaaatgtttgctaagtgctatgaatgacttagagaagtgctgtgtgagtcagtgaagggagacatcccttctgggagtcagacttcgcggaagagcggggccttaggatgaatgaacaagactttggtttttttagtgtgatacataattcaccatgcacatccagtgaatggtacacatttaaagcgtacactttgatatttttggacatatgtatccacccatgacgctatccccacaattataatactgcacatatccatgacccccaaaagttttctcatggttgatgagggagagagggagttatcatcagggcaggaaccaaagtgaaggtgcagaggctgggaaatgtaggggcttccatgagacagagggaggctggtgctggtgctcctgggggaagtgagggacgtgtgacaaggtggcctgaagaaaattgtgtggggcccaaaacactgggtcacaggggaatggggcaagtacttaaatttttgtaggacatggtcaaatgatgtatttgttaaaattccatcttttttcttttttgtgttgagacatggtctcgctctgctgcccagattagatggcagtggcgtcatcatagctcactgcatcctcagcctcctgggctcaagggatcctcccacctcagcctcctgagtagctgggactaaaggcatgcaccaccgcacctggctaatttttgtattttttgtagttgggatttcaccatgttgcccaggctggtctcgaacttcagatctgcccacctcagtttcccaaagtgtggggattacaggcgtgagccaccataccctgccaaaattttaccttttaaaaacaatggcaacaccaccaaattttaggtatttaatctttttgtagtaagtttaagaaaacacagccaagggcggatcatgaggtcaggaaatcgagaccatcctggctagcagagtgaaaccctgtctctaataaaaatacaaaatattagccaggcgtggtgatgggtgcctgtagtcccagctactcgggaggctgaggcaggagaatggtgtgaacctgggaggccgagcttgcagtgagccgagatcgcgccactgtactccagcctgggctacagagtgagactccgtctcaaaacaaaacaaaacaaaacaaaacagccaagtacatttatgcagcatttcatgaatatgaagtcaattaaaagaaaaagaaacattaagcaattttataattagataattaacagaatccttgatagccttatactaatacaactacttgcagattgaaaataattccatttgctgcctgctggcacattaaagcctacatgtaaaaaatacatcaagtctagatgggcttcagtcatttgaaagtaatattttagtgcattctagtataatcttgattagtgcttacatgcgtatagttcagcactttattttgtgtcatgttgaacatgaactttaaagttaagggaaacattttaagtacgtagtaggaatctactttcccatcttaagctctgaatctatttgtgaagggatcctatttcccaacagccaagggatatactggagaacaagattttcagggttgaagatacgctgatgtgaaatcaggtttctctctctttttttttttcttgagatggagtcacgctctgttgctcaggctggagtgcagtggcgcagtctcggctcactgcagcctccgcctcctgtgttccagtgattctcctgcctcagcctcccgggtagctgggattacaggcacgcaccaccacacctggttaatttttgtatttttagtagagacggggtttcactatgttggccaggctggtctcgaactcctgacctcaagtgatcctcctgcctcggcctcccaaagggctagggttgcaagagtgagccaccgcgtccaggccaggtttctctttctacatcttctgggaaaaggttggcagctcctaggagatactgaccagttagttgatgggtctgtgattcaaatcgaacatctagcaaagcccctacgaagcattagtcactcttgtgggagaaatgaggaagcgttttcagtaggctgttagagtgagaagcatcagattcttagttccatggaaatgaacgcctcttggagtgtttcatcttttaaaatagagaaggaagctgagagtcattcaggccatgctcagagatgtcagctcaggaactccaggaacccagtattattttgattccttccttccttccttcattccttccctccttccctcctttccttacttccctccctcccttccctccttccctcccttccttccttccttccgatatgggttttcctcatgttgtccaggctggtcttgaactgctggctcaactgatccacctgccttgctttgggctcccatagtgctgggattacaggtgtaagccaatgggcccagcctattgtgatttctttctttctttctttcttttttttttttttctgagacagggtctcactctgtcacccgggctggagtgcagtggtgagatctgagctcactgcaacctctgcctcccaggttcaagtgattctcgtgcctcagcctcctgagtagctgggattacaggcacctaccaccatgcccggctaatttttttatttttaggagagatggggtttctccacgttggccaggatggtctcaaactcttgacctcaagtgatccacccaccttgacctcccaaagttctgggattacaggtgtgagccactgcacccgggctgatttaagagggctttgacttgaccagatgtggtggttaagtgaatatgatatgttcccttctttatcatcctctctgttcttaattgcaaaagcgccaaatcctcctagataaaagacagccctaagatcattgtcaccatcctccttatcctcatcccaacattatatgaagttctaaatttatacaagttactgtattagatactgagactagttacattgataataattactaccatttatttaagggtgataataattactaccacttattcagcatttaccaagggccaggtctgtgctaaaaatgttgcacatattatcacatttaattcttacttaactcaataaaataagtatgattattgactcccatttttacattaaggagactgaagcttagagagatttgtgaaaaatggctcctggtcactcagctactaagtaatagaagcaggacttgaacctcccatacccttaaccaaaagttttcaaaatagtcaacactgtccataccatctagttggaaaagatgagacctggacataaaaactggccaggcagagtggctcacgcctgtaatcccagaactttgggaggctgaggtgggcagatcacctgaggtcaggagttcaagaccagcctggccaacatagtaaaactccatcggtactaaaaatacaaaaaaattagccgggtgtggcggtgaacgcctgtagtcccatccacttgggaggctgaggcaagagaattgcttgatgcagtgagccaaaatcacaccactgcactccagcctgggcaagagagaaagactctgtctcaaaaataaataaataaaagcattttcaggggttgtgacgagaaatgcctcacccattcttttgagtcatttatgaactgttcttaatcatgttacgttctaattaaacatctcccttttcttttgacgtggaaaagtctttaccttctgcaatacctttttcacatgttgcagcaagcagccctattaatcgcattcccacctgcctttggccctcccagctgcctcgcttgcagaacacgatcgttcaaacggaagtcattcatgggatcgcctctccctgcagtaatccagagcagaatcacttaggctgagcacagctgctacatcccagggtaatttggtttcttatgtagaaaaactgcggtctgacatttaacatttcctcctctggagagtgtttttttctttttttgtctctgtgaacttattacccagcatgtcttcacgcctttacattcagcgtgttcacgtgctcagcgcggtgttcatgcccgcaccattgtgtgatcaccatcactgggtgaagggctgtgggcttacaaagcagactgggaatcacaatgacaaaccttgggttcagactccgggtaggacagaaggaagtttctacctgagtttcatgctaatcaagtaggggtgcaggcgatcaagcaggggtgcaggggtgcacctgcgatctcagggcatggcctcgttgctgtcactactgcggttgttattttggctgtctcaggcctcacctggagcaaaccctaattctaacacactctgtgttctttcagatatcactcccctcttcttttcccgtctttccagaatgcgctgtgcttgtgtcctctttgccaatcagagtgagccgcttggggactttagtccatgcacatgtcgtgtcagtgcagatgatagaaccttgagggtggtgacttccccacccggagccatgggtcgtgattcctttgtcaggcgttctgattggttcctggcttccctctgcggtggtcgtataccttgtgtgtggttctgggagctcatgaacaacaggaatcaaggacactgacctttcgccatcagcaaactcctgctgtgtagattcaggggcgaagagagtctcgcggtgagaaatactctgggtgagaatgaccctctgtgtctccttggtccttcacaccccatcaagcacaggcggatcaggagatgtaaaggtcagggagctggtaagcatcgacgaacaaaatcttcctgaggaagggccgggtgcggtggctcatgccggtaatcccagcacgttgggaggccaaggtgggcagatcacgaggtcaagagatcaagaccatcctggccaagatggtgaaaccccgtctctactaaaaaaaaaaaaaaaaaaaaaaaattagccgggtgtggttgtgggcgcctgtagtcccagctactcaggaggctgaggcaggagaatcacttgaaccagggaggcggaggttgcagtgagccgagatcgcaccactgcgctccagtcttgcgacagagcaagactccatctcaaaaaaaaaaaaaaattttcctgaggaagaagtagcatccccgagctggcatgttgggagtatccttcaatttcagatgcttaaattctcctctctgacaatggctaattaagatttggccacattatctttatttctcttcttttgaaattagtgaggggacctgaccttgggtgatccgcccacctcagcctcccaaagtgctgggattacaggcgtgagccacggtgctccaccacctacgtgtcttcttgtattcctcttcatgggagaagtagggaaaaaatgatttggtatatattcctgaaagataagagtgttctaagtatcgaatccttacacttaaaactttaggttgaaaatgttgcccaagtgccaataaaaattgggaccttaaacatagaagttcaccttgtgggtgggcccatcgctgctcccgtgagactatctctgatccaggatggatcagagctaggtgatacagatgtctctgaagcccacgagctaggcagcacgacagactggatgcttcttttggtgccagctgatccagaggacatggccctagtccatctcctagggccactgccattctttttgtgtccatatcaggaaagcatggtataattcgaggcatctatggctctgaagacttcttttctctctctctctctttttgagacggagtctcgctctgttgtccaggctggagtgcagtggtgtgatctcagctcactgcaacctctgcctcccaggctcaagagattctcttgcctcagtctcctgagtagctgggattagaggcatgcaccaccaacccagctaatttttgcatttttagtagaaacagggtttcaccatgttgggcaggctggtctcggactcctgacctcaggtaatccacccacctcagcctcccaaagtgctggggttacaggcatgagccatcacgcccggcctccttttctcttttcttcctatttatgactaccctcccttaaagcagtatcttctttatttcagcacttacagaaagctatggctgttgaccattcctttttgaagttgtgagttgtactaaaatatttatgtataatgtgtggataagcacttgatttactgaggccttttgatgataagaactcacaaagggttttagatcaagggtggcttcattgaagaaacacctctgacatcagccagcaaccgcattttcattaaagactctcaatctcagcctttccctggacgagagaggaatgggttgttggctacttcctggctgtctgtggcggtcgtattgatgttgggcccagctgtgctgaatggctctgttggtgctcgctgggcttgctttggctggcacagctgtgagtggaggacagctgtgaggagcgggagttggtgctgattgatgtcttgtgaaccccggcggagcactgagctccatgtatgtacggattggtcctgtgagtcactacagactgggctagaggtggcagcagaggcatgtggcgttaggtagtacaggaaccaagaaggccctctggactgtgaactctcagagaacgggtgttgttctcatgcaccctcagacccccagcctggggcaacactgggcgtgcaggaaaccaaagtctccgcttgttaaatgtcagcagctgagccacaaatggcaataagctgaataaagaaggtggtgcttcaagggagaggagtaaaaacaaggaagaaaagagaagaggggccctcagagccagggatggctcatgcggtttctggagagtggttgtgtccctaggtcagagtcaaatccagactccaagggctagcgttggaaataaactgtgatgtgcagacatgacttctcaccctctctctctctctttttttttttttttttttttttgagatggagtcttgctctgttgccaggctggagtgcagtggtgtgatcttggctcacctctgcctcccgtgttcaagtcattctcctgcctcagcctgctgaattgctgggactacaggcgcccgccaccacgcccagctaatttttttgtattttagtacagatggtgtttcaccatgttggccaggatggtctcgatctcctgaccttgtgatccgcctgcctcggcctcccaaagtgctgggattacaggcatgagccaccgcgcccggctgaaatgacttctcttagagctgcctcctttctgtggcacctcttccatatgattgggttagtaaaaatattctaaataagcaattgatttgaggctttttgaagccaaacagtttggtgccttgagagcataagccattgcttatgtgaaaaaaaacaagaaactgtatctttgcatatactggggcccaaataaatcccgtttgaatgaatgaacatttcctagtgaaaacatggggctggaacccttctgtgtccgtgggaaaataggaatctattgatggatatggctctttggcttaaagtgaaaaatcatgaactggtggtcaagaaatctaggcatagtccacgcttttaaccctctgggacctgtttttctgtaaactgaggtgacgctctgttctggaacagcccctaaggggccgtttcaggtcctgctacacgctctgagttgtgattagagactctctggccctgtcatcgaggaggacgcctcgagacaggcctcatatggtttgcatcacttcctcaaccagactcgctcaacctgaacctcccattgcttcccatcattgtgtctggctgtcttgagtgtctccctcctgagccaccccttgctgctgcagtgtaaagaggcctcttgatttattaatcaattaatcagtgcgtgctgaggagctgttcggggtagttaaacagggaaaacaaacagctggagcctgcaatcaagatggatcctaattaagaaccaccccccaaatgctgatcttcctgccccgtcactgcctcacaactcccccccaccagcctacagctcagcaaaccgccttcagctctgatggggcttctaccccatgcaagctgacagtgaatttccgaagggcagattttctccctaatgtcctagaggtaaataagccttgagatgagcgttatcaattacctgcaacgactgttgagcccccaaatggcgtagtagccctgttcatataggcacagcccacactctcctatcccagttcccccacgaacggagtcatggagctggaaggtccttacgataaggagaggccatggcgctgtggacagacgagaggttcagtgaggttcagtgagttgtctgaggtcactgcagaactccaaggtcacaagtggcagaactggaaactatctgatactcaacgaacactcctggtgcttgtttctctgtgtaatcctaaagcaaagtaaataagagacattgttctcactgaatccattaaatgcttctgttccagtggtacttagcacacaatgctgagaaggccaagattttcttagaacagaacctctgttcgaggttgcaagttgcacctccatctgcaactaactttctgtggtaacagggggccaagggacctcagtgcagtggtccagaattgcactcaccccatatcatgcctggacaaatgtttgttccttctgattgaacaccttgggagagcccagggatggctataattcttcagtggatgtaagaataagaatgttcttgccaggcatggtggctcacgcctgtaatcccagcactttgggaggccgaggcgggtggatcacgaggtcaggagattgagaccatcctgtctaacacagtgaaaccccatctctactaaaagtacaaaaaattagctgggcgtggtggtgggcgcctgtagtcccagctatttgggaggctgaggcaggagaatcacttgaatccagaggtggaggttgcagtgagccgagatcgtgccattgcgctccagcctgggtgacaaggcgagactccatctcaaaaaaaaaaagaaaaaaaaaaatattcttgaccagcctggcgaagaagatacttagaagtcttatttatttttttaacttctttttgaaagttttcactataaaattcttacatttgtctaatgtgtttatcaaaaatagaggcttttctgccagtgtgtcttctcatttctgtggaatgccaatcaaactatccaactctttgagtacgtctcgggtttgactggtaagccaggtatctgacttgcactagcagccttggagttatagaatctcctctccctctgcttctgtgttctgtaggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccaggtaagtagcctgtgtgagccaggaagagcagggctggctggagtcaaagcggagaagtaggcagcacttccttccgctgcctcctcccgggaaccctgtaactcagagcccagtgtttccatgtggcccccacagagttctcatcaaggtgccccacccgggcctgcctgctttgagagggtgttgctacatcttccaaactttccacacctgccctttctctgctcttcagtgtctccttcctgagagaccctctttgtgtaagaggtccttgctggtccaggtgatgccagcgacttcccagccagcagatttaccacatggcagagccatgaagaggtaggccacacagatacttggactggggtccaagccccgacttgtccacttattagcagcgtgacttggcacaaggggtttgccctgtcttaggctcaagtccctcatttataaatggatgtgagtcacgagaattaaataaggtagtgtttgcatgacatgtaggccaacacctgccatatagtaggggatcattgttgtgcctgttaacagagattttagatattaagtgagagtgagatgagtgagatgcttttgaaccaaaggatattgtgagtcccaggaatcacggttttaaagcagcctgtggaagtgctggacattgctgagaataaaatatacgaaggaacagtgatccgtgttggcactctgccttccctgtctataccttccaaaagaggtgtagatgcccttcttaacctctcctcccttgacagacccaaattcttttctatttgcaactcaccttaagaactactgggattgggctgccaaaactgtttcttccttttcagttatttaaattagaacatgcccccaagtttctccatagaaataaaacacaggtcttaaatctcccagggaatctttaaagatgttctaattttgcccgggtgagttttctgttggatgaggactggatttttaatgtaagtggcctccatatcccctgcatcaggggtgtgggaagcagcagagagcattgaccgtcactggaatggagaggcggccacggtcaagggtgtattactcagagaagatagttggtacatacagcaaatgatcctggagacctcaggctttttctcacttgggtctgtcatggtgggtgtttggtaggtggccttctgctgcgatgtgaggactcagactagagacctcaggttatttctcacttgggtctgtcatagggggtgtttggtaggtggccttccgctgtgatgtgaggactcagacttcttccaccaaatgcgtcaccatcttccaggggcctcaagagtccttcaccagaccttctgtaaccagccaggaaatgagggaagatagagtgtgtggaggatctcacaggaggatttggggcccagctttgcatggaagtgatgtatgttgcttacatctatattccagtgacaagaatccagtctttgctgggcgtggtggctcacacttgtaatcccagcactgtgggaggccgaggtgggtggattgcttgagtacaggagttgaagaccagcctgggcatcctggcgaaaacccgtctctattaaaaaaaatacaaaaattagccaagtatggtggcatgcgcctgtagtgtcagctacttgggaggctgaaacgggaagatcgcctgagcccaggaggcggaggctgcagtgagccgagattgcaccactgcactccagcagcactgcactccagcctggtgacagagcaagactctgaattgggaaaaaagaagagtgagagagagagagagagagagagagagagacagacagacagacagacagtttagtctcttgatctcaccttcccactggtgaagctggggaagccaatctacccgtgagcccaggagaaaaaggaacaagtcgagtgaacacatagcatagttttgttacgccggacaagatacagggaaacgtggagtgagttaaatgtggttgataaaatgccgggtgactttctctagagcgtttgagagtgttcatgtctcttgctatcttgaaagaaagtgggaaacgttgatcattatcctaagatattagcattcttggacggtcgaaattttcacttaactgggtgctttctaatttacaaaatctaacatatggattatttcctttaaccccacagtaggcctatgaggtaggtggggcaggtgttagatcttccttttacagttaaggaatatgatgcttagagaaatggactgattgtggccacacagccagtggcagaaccagcaccagctctccccttgcccagggaatggctttgcctaccgcggtttcttccaactttcctaggctaccccaaagtaagctgccgacatcttttccagatatggttccttttcagacctggtgtcacaaagaaaagaactcgttttacctgcaggggcctcactgcccctagacttttggatagaatcttctgggatgtgtatataaatataatgaggaaccagtggcgtcctgtgcagtgcttcacattctaaccttggaagtaaccttctagggcaggaacagagaagggcttctttgcatcatgggataatttgcttttttttgtttgcagttttaaaatataccatttagaaaattatcaaaagtaacatatttgttgtaaaataaaatttaaaatacatgaggaagtttaaatgagactttaaaagtcgatgtcacccggatataaactatgtaacatttggggatacttcctcctagcatttcatacactcgcaatttgtaaaattgtgaccaggttcaattctgtgacctgcagttcacttaatacattgggtacatttccccatgccactatatgtttccctaaaatattatctttagcagtaacatatttcattatatgaatattttccacgctatggagatgtcctcatttattaggttggtgcaaaagtcattgcggtttttgtcattactttcaatggcaaaaaccgcaatgacttttgcacccacctaatatataaccaaacatcaattaattagaatttaggtctttgctactataaatacaatgctcaggtgaacatccttttacccaggccatagtttcaacacatgcctggcttgtgtgagccacatacttgtgttacacagacaactcacatttcaccttccaggactccgaagctcttgtcacacgtggcaggggccggttagaagactcggcggctgcgccagcgctgatgagcgaggacagaggagcatgaaactggtgctttcctgtaaaatattcaaagtgaggtgaaagtttgtgtgtaagtcggaaacactgaagatgctgcttaaacggccgattagggattatttgtgcgtttcttttatttgtgcaatgattctgttcttcctcttacttcccaaactcagatgaaagagaatttactgtacaagtatttattaatctctaaccaagtaccaggcactgtgctaggtggtgggtggggccgcagccttgggctggaaaccctggttcctgtcctgaggtccttgcagtgggacagaaggcaggtgagtgcagaggtgaagagatgccgcggtgctttgggggcatgcagacaggctcctaatcccgcccgatgtggcaaagccagatacaaccaagattcacacaagccaccaacttgtggtcatcctgggtatgttctgttgcttctttccaactccagaacagaccaattcatgcatttcccctcagtaatgaagggaccagaggaaatctctctgggataaagagatttggtgcctggctatgaatctgcgtcccctgtgttgtgactgtgtcgtcctgatgccctggggtgggggctctgggtctggccagactgagtgtctcctgttgcggacatctccctgcagtacatattgtacagttcgcagtctagccagctcgtcagagacggttgactgctctgaaagctgacctcatttttcctgcttacccatactcccacttccctccccacagagcagatggcctctggatcagtgccagagccattccccgggcagagaagcatctagaccttgtcactaccaagggtgcggctccacacccgcgggacccgagcctctagaaatgagggagaagacgactctgcctttctgcaatttagacgtcgcaaggatgaaaacgatgcggacaggctttccagcagtgagcctggggaaatctgcgtcacatgggcgacagaaggtccctcgaatccctcaatccccgtggcccgcaccactgtgtaataatctccaaaggttgcagtaggaagattcttgattctcgtttgctatatccttcacatttctaaagtacctccagaaagaccaggaacctgtaagcatcacagataaataggaatcgatccagagagattttaaaaagagtaatttaggaagtactaagatgacatcaaaaatgttgaacaaaccacaaagataattctcattaaatatcttagaaaattgatttaataggagattataagacgggctttcaaagaaagactttcttctgttcatctgcagacatttagcacaatctatacacacacagagaaagcagaaaattctctagcgcaggggtccccagaccccaggccacagattgataccactctgtggcctgttaaggagccagccgcagagcaggaggtgactggcgggtgggtgggcattacctcctgagctccatcccctgtcagagcagcagtgccattaggttctcctaggagcagaaaccctactgtgaactgtgcatgtgagggatctaggttgcatgctccttatgagaatctaatgcctgatgatctgaggtggagcagtttcatcccatctccgcgccctatttgtctgccatgaagctggtccctggtgccaaaaaggttgggaatcactgctctagaatcttcatcttttttcttccaacttttatttctggtttgggggtacacgtgcaggtttgttatgtgggtaaattgtgtgtcactggggtttgatgtacaaatgattttgtcacccaggtagtgagcatagtacccaaaaggtggttttccgatcctcaccctcctcccaccctccacccccaagtaggcccagtgtctattgttcctcgtctttgtagccatgtgttacagccttcatttgaccacatgaaattgtgactttgaaaggatgtgtctagattagttccttgtaatcaactacagattagttacctctttttgaatggcagctgcttttgcctgattaacatttattatagtcaataactgcaggaaagactgtacacataacacacggagttataggatgttggtgatgttggtgttggaatgcacctgtgtaggatggtaactgtcttttgcatcatggtaggagatttggagacagagtcttacctagttcaagcctgtggtcccaccaactattaaaccagtttagtagcttgacatcttagtctatttcctcacctatgaaattcctacctcatggggtgattatagggaacaattaagaagaaggcgtgaaaatattttatgaactataaagcaggaataccggtataaattatctatttcaaccttttcatttaccagaggagaaacctgaggctgagagatttgaagcttcttttgttcagagttttctaaatcctagtttgatctcttttgctaaatcacacactcttggacaacagggactcattttattctcacatccctcacagcagctaacgtgaaaatgttgttctttattagagacagctcctatctcagggatgcactacaattactttccatgactggccctagtttaggaaagaattccaggccaaagacctatctagaacccaaggatttaggtggaaaccaccaggtatttgattccaagctaatctttaacctgaagtgtcttaatcatacttaataaatccttagatgcagtggaaagaacctcgctggcatttcgatgccacactcaatacaggggcatttgaaaggatagaagagctttatttcataggatttcactcgattgaacttgtcaagaaaattcagaagatgttagcttaatctacaagtaataaatccatagtggaccgttgatgcaatgaaggtcgtccatgtgcattccttgagttgcaggaaaatgctcttgatacaatttttcctgctttctctaaaaacatgcattggaatgaatgtgagaggtaatgctggactgaacactggccgaagtcattatgaggtagtctctattacagctttagaaatgattgcgcctatgaagcacagccattactggactttacattttaagatatgagcacagtctgggcacggtggctcatgcctgtaatttcagcactttgggaggccaaggtgagaactgcttgaggccaggagttagagaccagcctaggcaacagagtaaaaccccttctctacacagaaataaaaaatcagccaggcgtggtggcatgcctgtagtcccagctactcaggagggtgaggcgagagggttccttgagcccaggagttccaggctgcaggaagatgtgattgtaccactgcctgtaacctgggtgacagagacccgagaacctatctcaaaaaaaaaaaaaaaaaaaaaaaaaaaaaaaaaaaatatatatatatatatatatatatatatatatatatatatatatgggcacaaaaggatgtaaaagcaacaccaacctcaacatatatcaaggtttgctaaatgacaggacctctgcggtgcataacacttgctcctccgagatcagaagccctgggggatcttggtgctagaggacttccaagcgcccctgcaggaggaaggtgaggctctgggaggcccaccaagtgctgttgtactcagaggctttgccgattgtggcttcgtggaaagcagaagcgtgtgttctagtatggctgatgtcgggagatgaggtatacacgtgctcttcccggccgaaccacttttcaagaaggaacaggggtgggtgtttccagcaggtcaggagtataggattttcatccacgttcttcgcagctcttgagggctcatccagccacttgtgccctgaaatatgcagcacaccccttcttgggccagcactggggtcacctgcttcccacttgctgctgtgtctacccagtcaggcaatagtgtaagatgccacgattagaccaattatgacgtggaagagattcttaagaccatgggttttgttttctcctgtttataggcggtcaaagggatattaggttatgtatctttatgctttttgacaaattatgaacatggaaaaaagaatcaatttgtatattcggtcatggacacacatttctcaaggctagagtgttcagggtgaaattccaaaagggtagtcacagcttatgaatatggatggggccgtggtctgaagggaacacccagacttcactaggaaacttcaaaaatacgttcaatctgggcgtttgcttggtgtggtagactgaataggggccccccaacgatgcccacaccctaatccccgcaatctgtggatgtgttaccttacatggtaaaagggcctcagcagatgtgattaagccaaggatcttgagatgggggatcatttaatttaattttattattattttttgagacggcgtctcactctgccacccaggctggagtgcaatggtgcgagcttggctcactgcaacctccacctcccaggttcaagcgattctcctgcctcaacctcgggattacaggcatggaccaccatgtccggctaatttttgtatttttagtagagatgaggtttcaccatgttgtccaggctggtctcaaactcctgacctcaggtgatctgcctgcctcagcctcccaaagtgctgggattacaggtatgaaccaccacatccggccaaggagatcattttagactatctgggtggactcaatgtaattacaaggatccttaaagaggaaggcaggaggatcagaaccagagagaggaggtggaaggacagaagcagaggtcagagaggagagagatacaaatctgttggctttgatgatggaagaaggaacctctagaagctgaggacggcaagggtgtgattctcccctagagcctccagaagaagccagccctgcagggccatttttgagttctggtctccagaactttaagagggtaagtttttgttgtttgaagctgctaaatgtgtgctattttgcttcagcagcaataggaagctattacaactggtgagccttctgttaactgaaaagcttggtaaggagaagcgggatggggtctacagaccaaggagtccctgcagaaacctgcaggacagcaagaacgtgggcttttcatctcacacaacaaaccccgttaccctgcggatcggccggtccatgcacaagtcagattctttcatctgggtgccaccacagaatgagaggttactcatactgcaccgctggtttgcgattgtctcagatttccctattgttatagaatcataataagtagcacaccacagcgactctccattggtagctagtcattacaattatgtaagtctcatactgttgaaactgcagaaatcattccaagctgggggtgggagggatggaaggaacgggaggggaaggagagacttcactgaatttcatgtagaaggaagttcatctttgctagaggccttttgatctgatagaaggagatctcacagaactgccccagcaataattcttacctcatctggtaaagatcttcataatgcatgcacttgaatgcactttggacgttgtagagcagcatgtgagtgtttgctggtatcacgttttatctggtaggcaggacacagtcaatggggattccggagcaggggaatgggaagatttctttgcctgaaagcaggaattctcaattttggcttcacactagaattacttgggagattaaaaaaaaaaatcctaatgcctaagccacaccccaggcgaattaaatgagaatatctgcaggtgggacccaggccttggtttgaacttggccaagtccaagaaccacagtgttaaggaagaatttatctggcactggcgtaataggtacagggaagagaacaatgaatgtgtgtggatagatgagtgataggctgagagacaggtgtttgtttcttatggctgccatcacaatttactactaactatgtggctttattttttattttttatttatttttttttgagactgagtcttgctctatcacccaggctggagtgcagcggcacaatcttggctcactccaacctccgcctcctaggttgaagtgattctcctgcctcagcctcctgagtagctgggattacaggtgcccaccaccacacccagctaatttttgtacttttagtagagacagggtttcaccatgttggccaggatggtctcgaactcctgacctcaggtgatctgcctgcctcagcctcccaaagtgctgggattacaggcgtgagccactgtgcctggctcactgcaacctctgcctcctgggttcaagtgatgctcatgcctcagcctcctgagtagctgagattacaggcacgcatcaccacgcctggctaatttttgtacttttagtagagacagggtttcaccatgttggtcaggctggtcttgaactcctgacctcaggtgacccacccgcctcagcctcccaaagtgctggaattacaggcgtgagccaccgcccccagcctgtggctttaaaagcaacaaaaatgtattctcatagttctggagactgcaagtctgaaatcaaggtgtcggccgtgctgtgcttcctctgaaggccccagggaagagtccttcctcgcccttctgttggctccaggtattccttggcttctgatgcatccctccaatctctgccttgggtctcgctgtgtcctcttcttttctataaggacaaaagccattgggtttagagtctaccccaatccagtaggatctcatctcaatccttaactactatatgggtgcaaaagcaattgtgggttttgccattaaaaatcatagcaatttctgcaattacttttgcacctatctaataattacatcttcaaagaccctatttccaaataaggtcacattctaaatagatagacagacagacagacagataactagctagctagataagatagataaataaaaagaagaaaagtgaagttgcagaggtaaaaggtacatgcgggctctttccttgctgaaccacttctgaagaaggagcaggtgcagcatccacggctggtcagcagtggaggattctcattcatgttctttgcttggaggaaaaaaaaggaacaagtggaaaagatgaaaacgggccaagtcgagagagggagggacgtgtcatacctgcatgcatccttatactggaggggagcctctcaagagccagacaaaatgaaaaaatgctcagggacaaagtcaacgatcaacctgtatgcgtgggtttttcatagaataacagcctcctcttctgaacttacagaataccttgtaagtcatttgtgctttcacagccacagacataaatgtaaacagcacctcttgggccaccacctgagagtagataaatttaagttgcgagcctaatcagactgctgctgggggagccttgttccttctctaccgatcaagctgataatttggtctgtattttttgtttttatctttagtaacatttctaggctctaaaaggaggctagaaacagcaggtaagatgctgtgtgccttcaaggggaatttcttagttactagtaatagttacttaccatccctccccctttttgatgtgggtgagaggggttaggtggggaggtggggggtggtgggaatgtggctattatcacccaagcaagggaggagttattttcccctcccaggcaaagcttgggttgggggcagagctgagcatccctgcacagggggtgaaacaggtgggagagaagattgcctagatgtagatgcttttcacagtcgtcttgtgtgttagaggtctgcccacatcctgtctcactcagccaccctccccagaccttgttccctcaggctgaattttcactttcctatgggttgaagaaaagagccagggagtatgcaggctccatggtgagcaggccaagggggaaacaacagctactgctttttttcattttaatgacaaagaaaacagatcgttttagaaagtctgaggctgatactcatcaatgattttatccaaatctcacacaatgagaggttggggtcatgctggatttgctgctcatgcaccagaaataaaacaccaggttccttgctgactgtgtgacctcaagcgggcttcttaactgctatgtgcctgaatttcctcctctgcagagtggaaacttccagagctgttgttgggatcatgtgagagggcgtgttttgcatacttagtgctgtgtgtgacacatggcgacttctccgtgaagttgactgaaccttgagcgccattttcttttactcaactcaagttcatgtgactcaagttaaatggaatcaggaccctcttttccattgtaagagccagtggcagatgaaaagacatcaatcaccaatttcataaagtgaatatcaagcacataaaataaatgttatcctgcaaatctgaaaacattccctccttgacatattgccaaaaaatcaactttccatatgtacatcacatctcgtgtgagaatgtcatattttaagtagatgtgatctcattttatcattagtgaattaataaaatactgaaaggctcattgaccagttttcccccatatttggggatctttctaagggaggagggaaagcagcaaatagattcgaatcatttaaaattttacagcgtagtggacaggtcacatttaaaataacccaaacaagtcaaacgttattattttggaattcatttgaaatatcaagcaattcaggcctagtttatgatttttttttttttttggtttgtgattcttaccgaactctttgaaacacaggactcagccctttcattcttggtttccttatctatatgcttatggtatattattaatatgtttgctttcctattcttttatgtatttataaaatataaacctttcttttaaaattattatataatttgcaagtttcgataaattggaaaattgaaatgtcctcggctggtcgcggtggctcatgcctgtaatcccagcactttgggaggccgagacaggtggaccacctgaggtcaggagttcaagaccagcctggctaagatgctgaaaccccgtctctactaaaatcacaaaaattagccaggcatggtggcatgtgcctgtaatcccagctcctcaggaggctgaggcaggagaatcgcttgaacccgggcggcagaggttgcagtgggccgagattgtgccattgcactccagcctgggcgacagagcaagactccgtctcaaaaaaaaaaaaaaaaagtcctcacctaccccaccccagacatacacctaattcatttctaattgagattttactgtgctaacagtctttagtgtgatgaattagcatgcctttatcttatagaggtatttgtgaggattagttaatgagtcatatatttcatatgcttaagtcactccgagggagtcatttaggtgtttagaagcatattagtcactaattttgggactctggagacttagtccatttctgcagcaccactggccccgaggagttaacatatccctccattgctcatctgagagcctgggcaatgacttgagacactggggagaaaaaaagattccatatgaaaagcaaagacagcagcagccatgtctatattcaaggctgtggctgggagttgtctaattagatgactcatctgagccagcctgatggtttccatcaccttcactaggctgctccccaccgtccattaggctgcaaggcgctgcgtcgccagggaggttgaccccacctgcttgttcatgacgtgctcccttttggttcaagcaacagacatggttggaagcaagactagaaggcagccctcaagaattacaaatgacaaaactgaggcccaggcctgtcaggcgacctgtgccaggtcacacggctaggaagtgacagcgatgggagtcaaacacaggtctcccatgcatttacccctgcccctgccccagcccctctctggagggaaggggaccgattcctcagataggtcagatttgcaggcctcctggggagggttacccaccgcacacactcctgacgtgatttctttgggggcaatttggggtgcctaggatttccaagccaggtttctcatcttattcctctgcatagcagtttagaactcaatgcgctgtattgtatctcctccctgggaggtggggaggttggtggggttaaaaccgaaagacactgatgggccaaaaagatgaaaaaaaaaaaaaaaaaaaaggctgtgtgggcaatgctgccatctagtgagacatactttagccaacctaagaagctgagtggtcctggtagaatcccaccgtaaagtatttcgatgtcctaagcttcatcaaaggagacagggccatctccctgtcagtagcgtggtctttaacacagtagtgaagggttaaattcagtgtcctaacatctgtccttcagaaaggacccgtggcctgaacagatcttctgtgagaatggagcttggttttggcctggtagaaagaccacacagatctgcatgtgagtgctggctcacctgcttagtagctgaggaatgtttgttgttgttgttttaattgtggtaaaatatgcctcatacaaaaaatgtgtcatctgaatcatttttaagtgtacagttcatcaagcttgtccaacccgcagcctgcagtctacatgaggcccaggatggctttgaacgcagcccaacacgagttcgtaaattttcttaaaacattgcgagatttttttggtgttttctttttgttttttaactcatcagctatcattagtgtcagtgttttttaagtgtggcctaagacagttcttcttcttccaatgtggcccagggaagccgaaagattggacacccctgactcttccatggcattaggtacattgacatgatgtgcagccatcaccaccatccatccacctccagaatactctgcatctccccaaactgcaactccacaccctttcaacactcactgcccattctccctcccaccagcccctggcaaacaccattccactttgtttccgtgaatctgactgctctatgtacctcatataagtgggatcacacagaacttcttctctggttaatggtctgttgcacttggcataatgtcctcaagtttcatccgtattgtgtcatatgtcagaatttccttccttttaagggctgagtagtatgctgctgtatgtatataccacattttgtttatccattaatgtatcaacattgagttgcttccatctcttggttcttgtgaataattctgctgtgaacatgggtatacacatgtttctttgaaaccttgctctcaattcttttggatatatccagaagtagaacggctgggtcaaatggtggttctgtttttaatttgttggggagccaccatactgttttccatagtagcggccccattttacactcccacaagagtgcatacgggttccaatttctccataccctccccagtacctttttcctcttcacagtagccatcctaatgggtgtgaggtggcatctcattgtggtgtggatctgcgtttccctcatcatgagtgatgttgagcatcttttcatgtctcttggccattggtaagctgagtaatatttggtaaattacttgaccactcaaagcctcaatttcctcttccatagaatggggatagtatctatcccctagtatagcatctatggcctaagattgctgtgaagattaagttcattattctaaaagaaataaattgtttttggttctgtacactgttctaagcacaggtttgtgtgtgtgtgtgtgtgtgttttgtttcttgttttgttttgttttgtttttgaggcagagtttcattcttgttgcccaggctgcagtgcaatggcacaatctcagctcatcacaatctccgcctcctgggttcaagcgattctcctgcctcagcctcccgagtagctgagattacaggcatgcaccaccacgcccggctaattttgtatttttagtacagacggggtttctccatgttggtcaggctggtcttgaactcccgacctcaggtgatccaccctcctcggcctcccaaagtgctgggattacaggtgtgagccaccactcctggctagcactggttttaaattatatatgtatattctatattgtatatatataaattatttttatgtgtgtcacaattttactaaatatatacttacatgtatttatatataaattatttttagtgaatatatattttatatatatacacacacacacatatatatatatgtatatgtatatatatatatacagagagagagagagagaggcaaactctgacctgagaagctctataaagtcaacccacacagattactcacagagcatggctctctgcttattgcagcccgaaggcaacacatttaaaggtgaggcagacatacctaaaataattaacatgcccctgaaaaacagcagtggaattggtgaatttagaaaaccgaggcatccctcacgtctgaacacggtatccctgaaaaatagcggtggaattggtgaatttagaaaaccgaggcatccctcacgtctgaacacggtatccgtgtgtttttagcagtaatctcatgatgaatatcctgaacacagccttcgtgcagggtccactctccagcttagagattcattcccagcctacttcaaaggcagctgagactgtgtattggagtttctgttcaagacaacggtgtcttgttttcctctaaagacagattgtactttctcatgtaaatagcctttttgatagaatgcaggtgcttccagggattaactgctgctattaggctaggtggcccactctctccaccctgttcaaacagccagtgcttcatcatagtttatgtaactggcaacttagaagcagcagcctctttgatgagtccattaggaggtaggagaaggattggtagcagagaaatgaaagttcttgcacacaaataatgagtagaaaggatgaacggtggttgctggtgctttctgaacaaaatgagggcaaggggtgctgtccactaataagtgtcatttagaggctttattcttctagaaaaagggctgcccatctgctctccactgagaaggtgatttgccgactgttcctgaacgtgtgcctgggttgctaaaacttgcggaacgtgtatcagctgttgaaatggcctttcctttgggaaaactgtgcagacagcaaagagagtacaaaacacgaaaatcttaattccattccctcttctgccactttcagtatgacctcgggcaggttttctacctgcacagagaaaaactgaagtcgcacgctgctcttggttttctcagcctggagcagatgcctttgagcagctaccacttcccgttcccctgacagtgtgctccggctttacgaggctgtttttctctccacagtcaccaagtccactgtctctccacagtcaccaagtccactgtctctctccactttgggggccatctgtgaatatcactaacttagcattacagtaccaaaaataataattatagctaccacttgtgtacttactatatgccaggcactgtgctgagggctttgtgtgtcttaatgcattcaagcttcataacattcctatgaagtaaattattcccattttaattagttagttaattaattcatcaagacaggatctctttctgttgcccagctggatactgtggtgtgatgacagctcatcgcagtctcaaactcctgggctcaagtggtcctcccactttgacctcccacagtgctggattacaagcatgaaccgccatgcctggcccattctcattttaaagataaggaaaatgaggtacaagttgatagaaacagacagtacctcaccacctgcatggaggaatcacgtatttatggagtcctgaacatttaatcaacaactgttttattgagcatttagtttgttattggttgaaattaagaagactggtaaataccatgaattaataaaaagttttatgttaatagtaaacttgtttaggaaatctggttttgtctgacttgaaatattaaggaaatatgtgtaggtttaggtaagaatatatatttggtttaggactgttcatattaagttacatagtcctcagccttaattcacctcacatctccccatacatcttatgtctttttctttcttctttttgctattaaattacagcatcacctcttgatcactctaagacctaatcatctagcttgtaaattattcatacttttccccctcacctcactcctctcttttggattttatccatttatctgcatctctgagaataggtgggcaacagaaataaaaggattcagtgaaaataagttcattctgtcatttattagcaacttacacaacaggtttggcagaaaagaaaatgggaactaaaatagagtaattaaaaagaaagtcacttatttaaacattgcatatcttgctacctcttctaagtagaaattaattagctcctaacagctaactaatagactaagtggaaaatagaccagtgcaacatttggggttaattggtacaaatatattgattacagtaactagtcattaaatgttttataaggtatatatgctattagtataatctctgtatggacatcatctactgagtgcatggatgccgtaaacacatcatgcttagaaccaggcgtttgaacgctgtctggagtacttttacattgtagtaccctgaatgtacatgcctgtttgttatcactgggagggcagctcaggacaggattataaagagatggaaagaggagcaaacctggggcggcgtggagctgtcatgagaatggtattttcgggagctggggaagaggcagagaaggaagggaaaacatttaaagagggcaaaacatggacttcatccgttagctctacagacacggcccttggtagttaggcgacgtgaagccacgtgtactcaggcaggtagtggggaaggctgcttctccaacagatggagacagggaggttggcagaccgctggcttaggaggaagacagcagcagaagggttgcgtgtgtgaaggcagggtcacagatatttagaacgaagcccaaagtccttggagattggttggatgtgggaaaagagagaggatggtgaggctgagactctggtttctgtgccaggtgttgcatggacggtgagctattaaccggtgcagagaaagccgaaagagtaaggctgagccatctgaggtcaggagttcaagaccaccctggccaacatggtgaaaccccatctctactaaaaatacaaaaattagccaggcatcgtggcacacacctgtaatcccagctactcaggaggctgaggcaggacaattgcttgaacctgggaggcgaaggttgcagtgagttgagattgtgccattgcactccagcctgggcaacagagcaagactgtgtctcaaaaaaaagaaagaaaaagaaaagtatcagtttagcaatattgaaatgtgcagcactcaattattagctgtattcagcctgctgtgtaattgatctaaaaaaaaaaagacagatttattcttcctatctaactgaggctttgtaccttttgagcccagtgactccggtgccttgatgggggccgggggctatgacccaggctttgctgagcgatgagggagcgtgctacttctggggtcagggctggagggctccagctgcccatctgggctgccactatggaggagagctagacattgaccacccaccatacaggatgtgtttgcctccccctcactcacaccctggttgtggcgtaggtaaacacagcaaggctcagagggctccaggaacctggctttaagattgccattagcatcatttcctccttaaacaacctcctatttacagctctccatcgataagatatgcaatgaacaacttcatcaggttaaactgcagcaaatgtcaccacttattttgtcactctctgatcttggggggagaaaaacagtgcagcataaaatattgaactgtttactcagtatttagttcattcagtgttttcggatgcccgctacgtgccagcggggagtaaagatgagacaggcttagtccttctcttgagggatctcaccaagtgcagtgtttggtgacgcaggtcacactggggacatgccatggcaggggcacagatatcagctgggggagcagagatgaaggccagatacgaattcccctgcgcatctgaaagaatgcttcatagctttgaattagatgaactgtttataggaacggtaatccagaaacaagtactaaatgttgtatggtagggtgtactagaggctgtattatctgacctaggtttttttttgttttttgttttttgttttttgttttttgagatggagtttcactcttgtcacccaagctggagtgcagtggcgtgatctctgctcgctgcaacctctgcctccccagttcaagcgattctcctgcctcagcctcccgagtagctgggactacagatgcccatcaccctacctggcaaatttttgtatttttattagagatgcggttttaccatgttggccaggctggtttcaaactctaagctcaggtgatccacctgccttggcctcccaaagtcctgggattacaggcattagccactatgcccggctccaatctaactcttgattcctcctttataactattcatcagactgagcaacttggcaagaacctgactatcaaaaacaaattagccaggcatggtggcacatgcctgtggtcccagtgctttgggaggctggggcgggaggatcgcttgagcctgcaggtctagactgcagtgagctatgatcacgccactgccctccagcctaaacaacagagtgagaccctatctcaaaaaaacccgcaacaaactaaaaaaaatccccgatatttctgcttccctaatatgcatgataccagcagcagacagggctgctttgacacctgcccaaagtgtagctggacatctatgtagactcatggagtttggggagaataggaaggcgtcaaggctaagtacaggtcccatctctctccctcatccacttcccccaacctctggtcattcaccaagaaacgttcacagtcctgggctgcgtttactaactttgttctcatgcgtgcttctatttttgaggccagaataggccattttgaaacctctggttccagccttccccttaggaaagtgagcggcagagttgcgacctctctccctggtggctcatctctgggagacgagcgctgtcctcagaagtgacgtggaagctatcgtgacagaggtgttttgggtcagaaactttccattagtatttggagaaaattgatctcattggagaaaggaccatgatatgaacaagtcaggttttttttttatcatagtattttttaaaaaacgttctaaggagaagatttacatgaccactttctttctgacggatacttcttcctggatggaaggaataggaaaagtacataaaatagctcacatggaaaatatttttcctttgatgaaaagtgaaactaaagtagcacttgcaggatgcacttttaattcctgaagcaaaagccgctacttgcaatgctaagtcacattgacgtcccagtcctgattgggccagatttcctctttctttctcatcttgtgttagcatttaaaactgccaagataatgactatgttaattaatctggcccaggatattttccccataaacaggagtgtgactgagtaggtccctcgttccttctacgtctgcctcccgccttccctagagagaagtgaatctaagtcatgctggaaaggtggtgcctaaactgtaccttaagggggaaagggctaacagcccttctcccatagccctttcagcactgtgatcaatctgacccttacactcaatttgtctacaattgtatctctattagcaatgctgctctgagtctgttgggtggaagacatccaattggtgggttgtttctgaacactggaccagcccaaggactatttcaaggaaagtcagggtgagatttgaactgtgcgcacctttgcctgaagccagtctcctgtaattgactctgggacagtaagcattgcagaagacagcagcgtccctgatgttggaaggaagtcaggcttgcagtaaaagcttatccagagaaagaatgtcattctctcaatctgtctctccctctctctctcttgccaggaaagttccgttttgttagctctagtgcttaatgatttcagggttcacactgtgtccactctcaaaaaagcccattttcttttttttgagacagagtttcactcttgtcacctgggctggagtgcgatggcatggcctcggctcactgcaacctctacctcctgggttcaagcaattctcctgcctcagcctcctgagtagctgggattacaggcatgcaccatcatgcccggctaattttgtatttttagtagagacagggtttcaccacattggccaggctggtcttgaactcctgacctcaggtgatccgcccacctcggcctcccaaagtgctaggattacaggcgtgagccaccactcctggccaaaaaaaaaaagcccattttccatgtacacacactcacatgtgcatgcaagtatacagtcttcctggcagaactggaatgagttaaattttgtccatttttattactagaattggctaatagggatccatagcttataatgcatcaacattaaaaatgaaattatattttgaggctcactgcatataaccatgtttaccctctgaaaagatattgtcctcccttgaatatttgacgcagtaaattatgttttggaggaatgcttaagttacctatgaagtatccatttttttaaatgttggttttttctattagtttttaaattaaatggtacatgcgcataatttaaagatctaagtcatttgataagacttgatatgagagacgccagcccaacactgtgaatgcagtgaggcctttcctcctttcccaaggctcattaatattcatctccctattttaacattcttaggttgctccttcttgatttacttagttaaagtttcctattacagcagttctcaaagtgtgctccacagaccatctgagtccctaagaccctttcactgggtttatgagatcgaaactattttcatgtaatactccgacgctatctgccttttttacggtgttgacatttgctctaatggcgcaaaggcaatgatggataaaactgctggcttctcagcatgaatcaaggtggtcacgccaagctatgctggtcatgctattactcattgtcatatatttggatatttggagggtttttttttttttaagaagtacagtgttacttgagtttattttattttattttttatttttgagacagagtctcactctgtcgccaggctggagtgcagtggtgcagtctcggctcactgcaacctccgcctcccgggttcaagtgattctcctgcctcatcctcctgagtagctgtgactacaggtgcccgccaccatgcctggctaatttctttgtatttttgtagacacggggtttcaccatgttggccaggatggtctcgtgatccactggcctcagcctcccaaagtgctaggattacaggtgtgagtcactgcgcccagcctacttgagtttatttgatgaggcagtgaaaataattttattgaatcaaaaaatgtatgttgacatgtgaagtacttgggtggcataggatggtcagttgcattagttgcaagctctactagcctttccccctctgccagtagaatacatttttacttgaaggaataacaaaccaacaaactatggttattgagaagtaggtattatgaagacattttctcaaaaggaatgaaagtttgccacttaaaggaaaataactaatggttattttcctttggtttgtttattaatcataaaattttggcctagcatgatggtacatgcctttagtccaaaccatttgggaggctgaggcaggaggatcactcaagtctggggaagttccagaccaacctgggcaatataacaagaccctgtctcaaaaaaaaaaaaaaaaaaaaaaaaaaaaaaaccaccataaaattttgagctttcaattaaaagataaaattttgaaaacttgattctactaccatgggcttgaaagctttccaatactaaaatatttttctggtaagatttgtggtgatattaacaaatgtgattttttgatactatattatggaatgggtcaacgtctggaagatacagataactcagtaaaccagtattttccaaatgacctttgcattatgttacaaaatcttgcaacataagatccatacaaagtacaaggtagcctaattgattttagtacaatgtgataccaaaagtttattaatatatttaatagtttcagattgctcatttcagtgaaattttaagaaactaccacttgttgatttttagtgtagtttctaagaacagtgtacacagttatctgaatactcctattcaaatactcctccatattccaactacttgtctttatgaggctgggttttctttagatatctcaacggaaaccacatatccagacataagccacataaccaaaataatataagcaactcattaaagagatttgtgggctggggatggtggctcacacctgtaatcccagcactttggcaggccaatttgggaggatcacttggggccaggggttcacggtcatgccttccaagatcatgccacggcactccagcctgagtgacaaagtaagaccctgactcaaaaaaaaaaaaaaaaaagagagagatttgtgaaaatgtaaaacagcaatgccacttttcttactaattttttgtttagaaaataattacatttcatacaatatttatgccaacatgtgatgggtttattattttaaaataaataaatgcatctatattttaaagttttcatttaatttctagtatggtgactatcaataggtatatagtgtatttacggttgctcttatgccagagcaaccagtccagactggagcagatcaggagaccctgggaaagaactcttcagaaagatggaatgattcttataactcctatgctggaacatttcgagagcagagttacagaacaagaaggagagttttggatggaattcccaataaatacatagaaaacaaagcaaattgaaaaaaaaaaaaagataaaaaaattgaaccatgaaggaagagctctctggggctctccgtaatgtttaagattatgaagagctcctgaaacgaaagagtttgagaatcaccggccttcggcgtaattacgaaacatgaaggggtagttctctttcgccaccacccaccccaatcctacgccacagaaatattcacttcttgtcttcccattgccctaacaatttgttatgatttgggttggatcaatattctatattatgatttatgtaaaggttatataaaaatattactctgagtacatagaggctgtttgcagctgagctgtgtaatgtggcttttcatttaaatgtacaaaagggatacattttttgataccttggatctgaaatatctctctaatttgccttaacacttgatggttggtttttggcttgatattagagttctaggttagatgtcattttcctcagaattgtgaaggcatttctctatggtcttagagcttctgatgttgctgttgaaaagtctgaatctggatcatttatgtaacacatctccctctcccttcccctttccctgcccgttcctctcctgaagcctgtctctttagtgttgagaaatgtcacagggatgtcttttggcgtggagctaatggcatcctttgtgctggcacttggcagtcctttcggtgtacaaattcatgttggcctgttctatgaaatattctttaattattttttaacactgtttttcctttcattttcttttttattgtttttgtaactcctattatttggtgttattgtctagtttaaaaattttggggggctgggtgcggtagctcatgcttgtaatcccagcacattgggaggtcatagtgggtggatcacctgaggtcaggagttcgggaccagcctggccaacatagtgaaaccccgcctctactaaagatacaaaaattagctgggcgtgatggcagatgcctgtaatcctagctactcgggaggctgaggcaggagaatctcttaaacccaggaggcagaggctgcagtgagccaagatcccgccactgcactccagcctgggcaacagagtgaaactctgtcttaaaagaaagaaaaaaaaaatttgtcttttctttcctatttgtcaaactttgtaaaaacttcatcttgtaaataattggttgagatgttcttttctgctgtaataattttaatttccaagagcttctctttgttgttactttgtctctgcatcttccttttttatggcattctgttcttgcttcatggatgcaatattttcattgatctctcagaatgtttgatacttggttttgtttcattctgtttcacttttattcttcctgtattgtttctccttccgcaaagatggcttctgttgttttgttttcttctcttttgtatcatatgttttcctcaaatatttggtgatccttggctgactgattgtaatttgggagtgagacgcagaataactcaaggaggagcatggaagggattggtgagtgtggtcttacctgtgtggtgacttgaagaagccattttcttccgtttctttaggtcttttcttttgagttgttgagatctcccaggaaagactcttctaatttccagcttgctgagtgtaaattttggctgccaggttttgggagctaagaggaagaagacaagggagatttcaaatttagtgtgtaaactttgactcagcccccttgtttttggtttcctgcttctaactgaacctagtgtgttctagcctagatgccctgggtgttattctctccaagaacaaacctttaatctctgccagatggggaggtacagtcacccagctacctgggggaggggaaggggtcagggattcgaactgcttcttaaacagaattgcaatcagtccccttggacttagctccaccgttgtcctcactgcctgcaatatctggggccaccaactcttgagccttttgggggttttgaggtctgaacggtgttgtttgcagctttgcctatcactagcttgagactcatctttggatctgctaagtcagttactgctcacctgtcttggctccagctgttaaaatcctgttgcagtttcttcctctcccattttctctgtcgtcgtgagtttctgccatcttaaaaattctttattgtcattttattagggtttcaggagagagcagtgctccatgcatgtatttaatccactaactttaaccagaagtatttttttaaacatttggaaagcaggctgcgtgccgtgactaatgcctgtaatcctagcattttaggaggccaaggcaggcagatcacctgaggtcaggagttcaagacaaacctggccaacatggtgaaatcccatctgtactaaaaatataaaaattaaccaggcgtggtggcacaggcctgtagtctcagttacttggaaggctgaggcaggagaattgcttgaaccagggaggcagaggttgcacagagccaagattgcaccactgcactccagcctgggcagcagagcaagactctgtctcaagaaataaaaaataaaaatataaaaatataaagcattaaaaagtaccttcaagtttttttctttctttttttttttttttttttgagatggagtttcactcttgttgcccgggctagagtgcaatggcacgatctcggctcaccgcagtctccacctcccaggttcaagtgagtctcctgcctcagcctcccgagtagctgatattacaggtgctcgccaccacgcctggctaattttttgtatttatagtagagatgggatttcaccatcttggccaggctggtttcgaactcctgacctcaggtgatcacaccctccttggcctcccaaagtgctaggattacaggactgagccatcacgcccagccaaggtgttttcttagtaggtgaaattactgagttagaagcatttattcaggacctactccttcttaaacaaagtcattgttttgtttcttcattcgcctatgtctgcaatattatagagctagttcaaaagtaagcagtttgattttggctccaacattgagcaatcataatgtaatactaggttcaaatgtgagtagatttgagtgcatgtcgatgttgaaaataaactcactattggagtgttttaggatgctctggctttccaggatggatattacttaggagtaggttggctctgggttttttcctgggttcttgatttgcttgatttggttcttatataatctattctttctttccctttccttctccagaaacagctcaaattatgaaataactttcaaaaacaagttaggtggtagtagtggaggtagtgaaggaaaacagggaactttcctgttcgctgcagagcaaaccaggtgccacgtagaccttctcagatgccactactggacgcagccctctagacctgaaggtatgctggatagacccggatagacccggcggggtgctgagcccaagcgtgtgccagggtgggaggatttacacttcagaaactggcagatgctatgaaatcagaaccttttttcctggcaagctggtatttaaatcttaaccagcatgcttctgtctagacctgactttactcttggggcaatctgatataccccccaaagtgtcataatcacgtcagcctacccgtatgacattgtatttattcactgcactgtgagctccagggagtccaggtgatagaataggcaaagggcaaaatttggagccagacagcctgacatttacatccttccttggctacttctagctctgtgacctttggcaaacctctgaaagcctcggcttcagtttcttaatctgtagaacagggggggaaatttcttcctagcgatggtgttgtaaaaaattcacaactgtggcagcctctgctctcccaaaaccatgtcctctagaaaatcctggctttatggagtaggttcctctgtggcctgtttctgtttggcagcaggcttgtgacgtctttgcttagggtccttatttttataacagaatactgactttttgtttatatggtttccaaaatttatgaagccactaatcaaaaacatgggatcagtgtacttcagactcttacaagggaatataatgttagacagacttctctccggtgctccaaatcccacaagaggaacagttttgttaaggggcagtcatttaaaggatgactcacaaattatctgtctattctaagttatacctttgaataaaattaaaataccaaataaaatatgtatgcattgggacaacatcaacataatcatttttataatcactcaaaactgtgtcttaatcatatggcttcaaacctttattgcaaattattataagaaatgctgtctctactaaaagtacaaaaattagccaggagtggtgacaggcgcctgtaatcccagctactcaggaggctgaggcaggagaatcgcttgaacccgggagacagaggttgcagtgagctgagatggcgccactgcattcctgggcaacgacaacagtgaaactccatctcaaaaaaaaaacaaaaaacaaaaaaaaaacaacaactatttgacttttgctttagcgtctgctatgaaccatgaatatagatgccaattatccattacatggttcagttttcctggcttacactgccctacacaagacatctgtccttgacacagggactaaccttgtctctcctaaggaattagtcatttttatcctcttagtaaggagttgtgaaatacatgatgtttccctatgcacctccgtgccaggaatgttagaatcaagttttgttatcaatcataagaactgtctaagattttcatttgacatgctacatttctactcctttttttttttttttggaaagggtttcactttgttgcccaggctggagtgcagtggcacaatcacagctcactgtagcctctaccaccctaggctcaagcaatcctcacaccacagcctcccgagtagctgggactataggcatgcgccaccacgcccagctaatttttgtattttttgtacagataggagttttgccacactgcccaggctggtagatttctcctcttgatcctgttttccacatgttcatttttttttttctttttttgagacagagtttcactcttattgcccaggctggggtgcaatggcatgatcccagtttaccgcatcctccacttcctgggttcaagcaattctcctgcctcagcctcccaagtagctgggattacaggcatgcaccaccacacccagctaatttttgtattattagtagaaatggtgtttcaccatgttggtcaggctggtatcgaactcccgacctcaggtgatccaccctcctccgcctcccaaagtgctgggattacaggcatgatccactgcgcctggcccacatgttcatttctagcttgttaactttattgtatttaccatactctcccactttttaaactacagattccttgtagaaaaatgaataaatgaatgaatgagtgaaggaaagtcagtggcaataactaatgatgtttttaaaattgtgtagtaagtggcatagttatgagatttgggggatttggggctggatcagacagagaaaacagaaggggaacatgccagtgtcttcaaatgtttgagacactgtagtttggaagagacagcggacatgatttttattgctcctgagaatagaataggagccaatgaatagactatccattaattgatttgttcatttctaagttatttcttatgcacctgctctctagggcatgtggacgaggtccagatgaggacaagtttcctgctctcaaatttcttgcattttagggaagtaatttttggctgacttgcaaagaactttctaatgagaagagttatataaccatgggatgtgttgccttgtgaagtagggagctttccatctttggagaatctcaaaaagggctgaatgaataccctgaaaaatactactccctcgggagagaaggtggatttgttgacctctagggtttggctctactgtgcttccatgtttctcttttatttgtcagtttccatcttaaactgaaggattaggtcatttcagggagttctggaggtgaggtggtgggaagcaataaaaataccttcacaaaccagttcctttactctttgatccaggtggttcccacaggtcccttgacccccgataaagtaatcccggctgcctgcgacggaggtgtaggcagccagggttcatggagcctgtggttatctccttacagagagccttatcagcttgtggagccaccgtaaagcttgctttgacctttggcagagactcctcctgtatgtctgtccacagaaatgagagcaggtgacagacacctgggatgatcctgagacccagcacccaaagcccaggcttctttctatggggaagtcaagcagagggacccaagctcatagccagtggaggggtgggttgatgagaggcgagccctttaccagatgtgagcccagtcatcactctgcattttctacgcaaaagtccaggggcttgctattgaaattaggcaaagaggacaaagaattgccctctgtaaagtcctcaaaaaattataaattataatttttataaaatgatagaattctaaaataaaatttttataaaattataaattttatatatatataatttcctggaaataacttacagaaaagttgcaagaataaaaatagtacaaaggacacccttattcactgtactccgttagcaattaactattttttctggaccatttgtgagtaagatgcgtataccattagcctttatcctgaagctcttcgatgcatatttcctgggaaatgagatatgctgtcacgtagccagagtacacttatcagcttcagtaaaattaacattgatgagtacccttatggaatctatcatgcatgttccaatttgttttcagttgacctgataatgtcctttacagcattgtctccctccagtgaggggtccagtctaggatcagattgcatttcgttgtcgtgtctctttttgagggtcttttaactgtaccattattattgttatctgtcatcttattagcttattcaaagttgttagaggtatttcttatttagggtacatctcatttacaatcatcctttcgttcacttgaaaatgaaggctaggttctctggagtccagactcactccccttctatgtgaagtgttttcctgtgtatggtggaagggatgggggtgagaaattttggatgtacattatgtacatggttgacttttctttgtttgatttaaatcatacaaaaacagatcagatcctttgagatcattttcaaattccgctgttgtcaatccgacttattgccaaggagatcgtcccttcatccttgaggaggaagaaaggatcattttgagaatcttcgtttcatatcaagacaacacactcttctgaatctagaaacagaaatacctttacatttacttacagcccttatctcagcactttcatgcatcttatgagaagcaacacgcatgataattaagcatttctatgcatgcagagctttggttagcttggtaaagggtatgttcagcaattctggtccctgccctccagaaaaacttgcttaagatgcaccaatatgcattattaaatataataacacatcaagtaaaaactatgcctaacactcgcaggctatcatacagacttagaattattgagatgatttttcagatggtaacatttaatcacagagaagctgaataatttgccgaagtttactttaaaaaaaatcagagctacgataccaatgttcagtacctttctttcttagtataatcccctactttcaaaataacctttatagatatttctagtatctacgctaagaaaaagagtaatggtgaaagactgagagaagacactgctttttaaaggctatagaaatctggtacatggcttctttgaagaaaaaaaattaaatggaaggaaaattggctgctcattttctgagggtgcaattttatatagaagatatttcactgtggtctgtatttaacaagctgcggggaccctaaggctggtagatggtcagactggtaacattttctaatgtgactctgataattttgacataggctttctttttggctgccctaagtatttatccttttcacctgatttactttacattcgcctattttaccatgggttacagacaagaacaaattggactcttaaaatggcatataattttaatattttctgagtttctagtattctaaattcataattataacctgagggatgtatgcccacagggcataaaacaatcacatagatagtgagttttttttttttttttttgaaattaccttggctacttgaggattctctacacccctgctatccagcatgggggccaccagccacatggggctactgagcattgagacgtggctagtctgaactgaatgtgactggtctgtataaaatacatattagagttcaaagacttggtacattaaaaagaatgtaaaatatctcattagtagacttttttatattgattacatgttgaaatgataatattttggatatgcagggttaaatgaaatgttattaaagttaatttcacctgtttctttttaattttttgatgtggctactagaaaaccccaaattccatatgtggtttgcatttgtggctcccattatatttctgttggaaagctcagctctagaaggaaagaaaatacataaaaaaagaccaaaaaaaacccaactcattcagtgtattttagagtgaattacggaagggaaagctgaatagccaatgatcccattttttttcttgattaggtttggagttcattaaagcttctttaattaaatatattgtaaatctgcttcaagttcccagttgagatgagaattgaatctttttgtttaattttaaaaattctaagaaaatcctgaactcacttcaaaagcgacttgttttttgaaatctttgtaaaaagctttccatttacatggattggaggtctgattaatatagagttttgaaggggctaaagaggtgtgaaaattatccagaaacttctgaaaggacctttcttatctcacaggcatccagggagacataagggcccttagaagccgcagatcagccataagcatctgtgttcacagtttccttccaataagcaaaaacactgggagagataacatatttattcctaggtgtctataactgaatttatgggtgtaacttgctggatattattgcccttgtaaacccatgtaactgcacacgtaaagcatgtttttattagttcctacataaaatttttatgataatggcaaacaaaggaccaatttagtttagctgagtttgttcttattactccagcttccaatagataagcaacagtgcaaacagcaggctgggcgcggtggctcacgcctgtaatcccagcagtttgggaggccgaggcgggcggattgcttgaggtcaggagttcgagaccagcctggccaacatggtgaaaccccatctctagtaaaaatacaaaaaattatctgggcgtggtggcacatgcctataatcccagctactcaggaggctgaggcatgagaattgcttgaactcgggaggcggaggttgcagtgagcctagatagagccattgcactccagcctgggagacagagcgagattccatctccaaacaaacaaacaaacaaagaaacacacacacacaaaaacaccaccaaaaaaaacccccgaaacagcaacaacaacaacaaaaaaaacaccccactgcaaatagcagcagtcaacagggaagagagagtcagtgcttgcagggctggggctcctggcctgtgggtaaggaggattgaggctcccctaggcctcatgggactgcagtagggtgaggctgggctggcctgccctcagcttgcaagcctgttgttgagcagctgttctccacgttggtagctgtggagtattctaatttagcttctgaaaaggcttgcatagctagtattgaaagaactcccacttactgtatttcagctggagaattacagagaaaaaaggttcaagtggcttattgtaggtcatctcccactctgggatttaaacaaagcacaaacagaacaaagttcctttaaactgggtgccttcatctgagtccctcctgtctgcaaggtttggcaggctcgctggatacagagcccacgcctctcattctcactgctgcctttttatgtttgacccttggatgtggccaacgattcccatggtgacctggattggagggaagtttttctagaatttgaagataaagcatctttcataaatactgcctgttccttcccaatgactagttaaaaattgatagtctgtaaactagagtgagtgcgatccgtgaacccaaattcaggagacagagtttgacgtgtctaaatgtacgcaggggacaatagcaagaaatattttaagctgaatgagcctgaaatataaaagacataggattgttatagatatgtcatactgaaggctgccttggatggaaaatcaactgaaaaaagggcaagcttagtacacactaggtttattctgggctaaggccggtctaggacattcatgaaattacaacttagtgattaggggctatagtggtttagattctagactttagaagtatttacacatcaaaaaactcatggctgcgaagagttttcctcctagcatctgacacaactcctcattttgtaagtctgtactggagtgaattctagacagctggcttgttgtatttatttttatttttagaaatggggtctcactctgttgcccatgctggagtgcagaggtgcaatcgtagctcactgtggccttgaactcctgggctcaaatgatcctcctgcctcagcctccccagtagctgggactacaggtgtgcaccaccatgtctggctaatttttaaaaaaattttttgtagagatggggtcttgctatgctgcccaggctggacttgaactcctaggctcaagtgatcctcctgcctcagcctcccaagtagttgggactacagggacacaccaccctgccgagcttgactagttatattgttcttaaaggtttatagaaggaaggagcttctgtagcctccaaccccatttttcggatgcgttcctttaaggactaatccaatttgaggttctttattctatttcctcagtgggcatgtttactgatcctcaaatgtgcctttatatatttcataagctgtttctttgcattctttcccccaaaggagtagtttccattctttctgaaaaacactgcttgagcctcgtcccttttggaagagcagttctggggtgtgtgtgtgtgcgcgcgcatgtgtgtgtgtccacgtgcatgcgtgtgtgtgcatggggggtgtgtgtctgcatgcctgtgtgtgtccacgtgtgtgtgtttctttggcctcctctcaggctctgggggaaaaaaacctctactaaatcttaagctaagtacaaaatgtgtgcatgtttcactcttgccaacgttttagacttctggtgttaagccctgtggaaatgcaaatagcatagtttttaatacttactctaagggtactatttagggaagtaaaagttactctaaaggcaagattgatttcctgccctcatggaactgacctttcataatagatagcttgttgtccatgctaacaagggcttactacaagtgctacgtattctcaatttgtatcaaaaattgtagtttggggccactggcttctttttggagatggcctgattgattccagactctggatctgagaagctgacggttttgtaccattgccctacacacatggaaacactgcagacttcaaagttcctttgttttaagtgcggtggaatcatagttgaggggacagtgaaggaagaggacagactgagctgaggtgttgttgctgctttctctcaaaaggttgttaagagatcattcatttttgaggaattgcaacaagactgatttttttttttttttataaagcgtagagtcttttaactcaggattagatgaatagcttttcaaatgtgtatgaaagacaagaatcccaaaagattggctctattttaaatagcagactccagggactcaaggtttgtaacaaaagggcagatatggaagagatgaactcccgggtccaactctgagaatagagcaccctcagggctggggatccctgaggtgtcagggaatgccaatctcgctggttccggtttattagctcggggaatctcgttagatatcctcacaataagctagttggtattgactttgcctgacccatattataaagttctaacaagtggaaagtatagccaagctttgggaaatgccatagcatgcagaatagaagagaaaaccagcgtcttaaatgaacagaggagaaatttgagcagaaccaccaactggagaaattaggacactggctggaatgttacagccacaacaggggaaaaaagcagaatatttacttagtgaagacataatgagatggtacaattctctggtgtcaactttcacagaagagctttgtctctgtgctaatgatgcagagagcagggaagtgatgagaaaattgtatagacctcaagaaatccaacaacagcaaaaaaagaatttggagtttagttttgtatcttctgaggtccaggatttttccatctccctaaatttgagaattcaggttcaaggaaggacttggagaatagtcaaaacattactacacttcttaaagcattcttaatggtatttttactagtgaaatagaaaatgaaaacacacacatgtaaataagcatattttattaatcctccaaatgccctgggtaaaccagtttagaaaaccatcagatgcaaagtctgtcatgggtctggtgacgagattaggatcagtcctaattaggattaatgaaacagagtttcccgggaagcaactgtgacaagctgttctttgaattctggacatgtaggaatgatgtgaaagtctagatgatcagcctcatggagtaagggatccgaacctccaaagggaataggcagaagaacaatttcaaatatcttcataagatcagcccacaaatgtttgcctacccgtgtgcaggtttgcaattagaggctttagagcattggttttgattcttaagccatttttatttgaggagaaagatgcctgagagtgtttttagttaatattccttatggcaaatctgtgattttgcaactaggatgcagagaggttaattgactttattaaggtcccacagctggtcatttgggtagaactgagcccctggcttatggctaacctacagagactctccctctctgtatttctaggattttcagtcatttcagagttctgctgtcctattgatgttgttttttttttttgtatgcatgaataagtgctgcaattaacgggctgtggcgtgaactaggggtgtgaatcaggatcactcatcccaccaagttgggcttctgtgtcttcatgtttccacatggaacttggcctggaatagatctaagggcttttccagctccatttttaaaaattgcttactgaattgtgtaggatttggtatttctgcagttggcaaacagaatacaaggtttggtgtcaagtcgaaactggaaccatgtaagccattgcattactctggaacaatcagctgactctgaaacaattcttgttcaccaatgacagtttgggaattttttcccagtttggtagggaatttcttttttgtcatttttgatatgtttgtatgtttttgcacaaaggccactcaaaggttaagtcggggcattttttagagatgtaatgggaatatctgtaaatggtcctgctttagactggattatgactttaggaagcacagggcacgttcagccgcatggccctccagtcatcctatgtgcagtctcacacgttccccactctggggaaattgaggcaaagagaggggagatgagtcgcccatagcctcccttgttgctcccaccaagccaggcccagaattagttcctaacacttaatgtaacgtttaccaggggcctgatgcctgacacaccctttgctaggcactaggattacagtgacaagttaatttggtccagcctgtctccaatttgggcatctccttcgtggctgtggtatggagtggctcagggtataatgcactgctggttgccttgaaagtttcccaagcattagccaagacttaggtgaagaacttggacatggaggtgacgtaggccctgggaagggactgcctaaagatgtatgttcatgggctccacagacaagaaagacatggcagattaaacatggatagaaaagggcatgatgtgtattagaattaaatgctgcagcagttccagctaatctaatttcagtctcttaatctcattgtctttccccttggcagcataactaataaacaatgccactctgcaacagttacataaagcacgtattcaatagtcaaaaattccaagctcttttcttcaaaggttaggtctattttttattttattttattacttattattatttttttgagacagagtcttgccctgtcacccaggctggagtgtagtggtgcgatctcggctcactgcagcttctgcctcccgggttcaagtgattcttctgcctcagcctcctgagtagctgggactacaggtgcgcaccaccacgcctggctaatttttgtatttttagtagagacaaggttttaccatgttggccaggctggtcttgaacccctgacctcaagtgatctgcctgccttggcctcccaaagtgctgggatgacaggtgtaagccactgtgcccggcccaggtctattttttaaatggataaaagaaagagggtggctcaattttgtgacagggtctttaaatttgtcagtttgtgcatttcatcttctggtgccccagagctctgagtgtagctgaaactcatgcccggtatggggaagaaccggggcagggtggggccctttagcctctgggtttggtttctcctctcctggaacctgtattcctatgattacttgccccatattccagagaattccagctctgcagctgtggctgtcgcatctcacactcaaactgactgagatgaacaattactggttttctctccccgcttcccatctctttgtgtacattgctttttgtttttctcttttttcttccttctcccatttctctctttttctttttgttcttttttctctctttgttccttgtttgccctttcttccccgaatccagcaatttgtcttactaccactatattgaattatgtataagccgaagcatcttagttcattcaataaagctttctgtaccctattcaccatgttaaaaatcaagtgaaaacaaagttttatcccttaaaaacaaacaaaactccaacaaccccaacccaactaaattaagtccattcctatttgtatacatctgttaattaatgtatgaattaatgtatttattagataaattccatatccagacacatcctatactggtaatactaaggagaacagacacagtccctaaggtcctaaggttgactatttacttggggagagagactgacaacaggcagttacaaagcaagacatgctgtaggccctgggattgcatggacagtgtccactgtcagtggagtcctgtggagggggtggcgctgatcattcagtgcggggaacaagtggtcaagacatgcttcctggggcactggctcttggttgactatttgggagtgagaaacagtggtagcctttgcccaatagaagagccgcccccaggtgattctgtacataggagctggcctaggagtagcctctggcctgaccctgacatcagggttgagttgattagggttgtgattccatcttgactactcagtctgaatttgctgagttgcaaattgaaagtgaaatcaattacatccagattcagaccatttgattttattttcatttgatcataaacatcacaaaacacgggatagagagagcctattgtgctcagttattcaaataatcctaattatgatcactcattcaaatgattcttaaatgattctttttttttttttttttttttttgaaacacagtcttgctctgtcacctaggctggagtgcagtggtgcgatctcagctcactgcaacctccgcctcctgggttcaagcaatcctcctgtctcagcctcctgagtagctgggcttataggcacacgccaccatgcctggctaatttttgtatttttagtagagacggggtttcaccatattggtcaggctggtcttgaactcctgacctcaggtgatccacccgcctcggcctcccaaagtgttggaattaccagcgtgagccaccgcgtccggccccaaatgattcttttttttaaaatacaatcttttgctgttagcacattttctgaagagggtggctctacttgagccgtacattctctggatgatgtgggcctgagctgcccaatatgaactcaagagtagcgagaaaccaagcccacaggccttatctgctccagggcttttccacctggcagacggaattgaagctcttactcgatcgcagttgtgcctgcttcacagggttgttgtcagtattaaatgtgtcaatacaaataaagctctcagaacagaagcccgctcatggtaagtgctcaaaagtggcaatggtgataatgatgatctatgagcccacctgtttcacatcctcaaaggcctctgaggctgaagctgatctcatcatgtcaactggactccttgtttcattatacaccctgactatgtcgctgaaaacaccccccaaaacatcactgaggaataagtattgagatccagcatacctgcaaggtgaattcacatgcatatgtgcaaaactgcaagcttcatggtgggaccatatcacctcttctaggagactctttttaaaaagcttgatctctatcttaagccacacatgttggaactaagaaatctaagggaggaaccccagatagagatgcagttggccctttgctgaatctcggtccttcctggagcaggcgggcagccctgcccctttatcttctggcaatacaaaggataaaagaaaacagttatcaggtgctgaggggccagatctgagccccgataatgggaatcctgaaacatgagcagcctcttctgtttgcagagtctcatcatgcaaggcagagtgctggaggtagggctataaattgagggtgaaggaaaggcagccctcctaggccctgcgtatcgccagttgtggaattctcttttgcaagaggtcactgagtcaaatgctgtggatggataattttatggccactaataaaatttatagccaaagcaagctaagataataagagtaatcaaacgtccagccctgggacataagaatcccatcctggcctggggtgctggctgggggtgctggacagcacagagaggagtttatctgtctgactcaaggccagcctcagagtctcagaggtgatttgtgtccacatgaactgcgaggactaggccaggtctggggcaagcttcagcttgggcagtaactgctgtttctctgcagacagcatgccaacagcagcaggaaaaagctatatcctatttaaatgcctaaaagcaaatcgtgagcctaagaaaagatctgaaccaccccagctctggaatactacattatggaaggaatgctaactggtcattcacgtgtgacttgccaggtgtgagggaagataaagaaggatgcaagtattactcatgcaagtataaagaaatcagatgacgtttaaccaaagagttgggtttgtgtgggggctttcccctgcccatctcctccctcttctccgagcttagctcctctctgagtttccttcccatcccagttcttcctcctgtaggcctggggcataggcaaagtgggatcttgtcactgaggccaccctgcagaacacacctcgtgacatctatagaggcatatcagtcactggaagacagaaaccctgggttcttggccctcttctcttgactcgggcctcaccgttgatggtccttatgaccacactctctaaaatggcacagcaggtaggtagccacgtggaacaagttgagaacaagtaacactctggtgttgtgggattctctctctctctctcttattttttgagacagggtctcgctctgtcacccaagctggagtgcagtggcacaatcatagctcactgtagcccccaaccacccaagctcaagagatcctcccacctcagcctcccgagtagctggaattacaggcgcgtgccaccatgcctgcctaatttttgtatttttggtagagacagggtttcaccatgttacccagcctggtcttgaactcctgagctcaagcaatctgtctgcctcggccccccaaaggcttgagccaccccacctggccttctttctttttttattgtggtaaaatatatataacctaaaatttaccatcttcaccatttttaagcatgcagttctgtgacattaagtatattcacattgttacacaaccatcaccaccatctaccaccaaaagaactttttcatcttcccaaactgtaactctgcccccgttaacaataactctatgaatttgactattttaggtacttcagataggtggaatcatacaatatttgctcttctgtattatttttaaataaaaactcttttgatgagataggtcagagaaaatccattttattgccctagtttttagtacattttattcaaacaagaacccagcaatagttaacttgctgcaatgtctactgagacgtctaaaccaaaacatgtcttgctgatgccagcttttgccctcttcacaaatcctgcttaggaaaggttcatgacactgccacagtaggcctgaccctgccagggaaaggcatcaccgcggttctgggtagctctggtgtgcgcgaagaaaagagacaagcagggtgagagtgaagtctaaatggatcaacaagtttgcctgataccttggagtcaggaagcacgggaagaaagagttgagtggaatagcttagtgaggtctgaggcctgcctgatccagaggagacactgacaaacacagacgctgcagaagaggaagccgtcccaggttaggaggcatcccagtgcttccctcctcagtgagtcatttcatctgtttctctgcctgcaaggaagaaataaacataactcataaaatgaagcatttcacctcgccgggggagtggcattgaagtgagaggcatgcatctgtgggtgtcagagcaagagtcctctgtagctgcttgtccttgacctggaaggaagggtctggtggggtgacaaagtgacatctgctccttagagggagcctgttcttggagacccctctgccagatacatttttatagtcagctccagaagtgacttgatgtggggattgagacatattcctgcagtcaaagactcatacatagaaagggacataatttttttttctttctctctcttatgagcaaagactgaataaggcttatgtggactctatcactgcatcgtgatgactggagtaaggtgccctccgtccatcatcgtcagctttctattctgtgtctgactgcagtggaacatcggcgtgatcaactctacattatttaactttgatccgggcgtgcattgtttgatcttttcctttgcagattgactttcataatttatattttatagaatacacagaaatgtattctggcatattctaagagcataacggctgacagcatagacacatcctaagacaatactaagggtttacaaattagctgtggatggtcttttccaagataattgtgagttgatttgtgctaacctggatcagaaatatttatcaagcactcactgtttacaaaactataaaagcattaagtaacagtgtaagtagcagatagcaataaaagatgtcccaaggcagtgagatattaattgtgtaagagaaaatgttattaaatgttattttctgggatttgaggagggggagcctgtcattaaatgtcattaattaaagactgagtaggaagcaattgctctccgtagatgtctctacacaggaaacggatactgtttggtgttccctgctgtcttggcagagtcagagggaggtagctttctgggtcaataatgccgtttaagatgaacgcccatgctgacacactctggtagctctcagagtccttccttcagtgtagaagttaaaggtcagcagcttacagattgcaatttgcattgtggaagcaaccttaggaagagccacacgtcttttatcttgattctgtggtcaagatggtaaccacatttgggattctctctttctttgggattctctctttctttgggaatgagtaccaagctcctcatactgaggtatcagtgtagacatttaaatgtggttgaaagacgtgaattaaaagttaaaatagaaggagaagctttatttcgatgtggcctgtgaaaagcagactttcactgctcgttaatggtgcacggaattctcatggacgttgagaatgtcacatgtacacgcacatgcacacgtgtcgacacctgcgcagacacacatgtgcaccctctccctgcagcctggccccttttgctgccacctgtattcattttcccaccaccccgagggatatgatgtgctgtttggaaagtaacagatatccttaaggagtgaaatggtcccctgtaatcaagatggagagctaaaaacaggtttcaatcagaactaaaccaaataaaatcccgtggtgaaaatttagttccccttaaagcttgtgattaggaccaccccgtgtgttttcggccactgcttttagacggtgacagtgacacatacacgtaacgaagataatgaggcctttccactagcactgtagggttttcaaacatgttagatggatatttggaggttttctcaggaagaatcatgtatctttcacagtatcgcaagagaagaaataaattcctaagagtctaacacgcagatgtaagccatagtcctttaaaaataaggctcttggccaggtgcggtggctcacgcctgtaatcctagcactttgggaggctgaggtggatggatcacaaggtcaggagtttgagaccagcctagtcaatatggtgaaaccctgtctctactaaaaaaatagaaaaattagctgggcatggtggcgtccacctgtaatcccagctactcaggaggctgaggcgggagaatcgcttgaacccggaaggcggaggttgcagtgagccgagattgcaccactgcactccagcctgggtgacagaacaagactccatctcaaaaataaataaataaataacaaaagtaaggctcttgattcagaattatgcagtgaggctcaagtttcaggagaacatcttctaatagtggactgcagggaggggctctgagggcagcctcgagttaggaagtggtcctgaaggggagagtggagggagggagatggaactgaggcctgacatgctgcacagaagccacctcagccgaatggatcagcatcccaaccgtggctcctcctcctactagctgatttcccttggggaaggagctcaacctctctgaccctcagttccctctttggtgaaagggttgaattgtcttggaatccacaggtgaccacctcaggactgcagtgagggatctgtatgcatccagtaaagcctgtccttagctctgtcttgtggctgcccacctggcctgggggccagagatggggctggagaaggggcaggcttcctccgggagctcatccccacacccagtggagttagcgtagccaaggcttccagcagagttttacatccagagtcatctttgttataggtagcagcaagaagcagtctctcctgggaagacttgctttgaagtgtggggagtcgcactgacttgtaggaaaggccactgccttgagatgaaattccaaagccaagaggaaaagtgctgttgaggaggtgggatgggaggtcaactcctcaagtccctcaaggaattcagtggaagccactcctgagaaccggctggaggtgggaagcctgaagaatgagggagttcacggtaggggcctgaggtgcgtgaggcttgtttgtgttggtctgagcagggctgaagccgtgggcccagggcctctttccttcagaaacagtcggaagtgaccaagcttcagctcctcctcctccccaggcctcggcacccaggcccggtgctgcggggctcacgtatgggaactgagaaagggaatatggagtcttccttctaggccccacagaggcctctttgacctcaagacttggctagaaacacattttggaagcttccgcatttccaagtcacagataatatttctacacacacacagacacacgctcttattttagagaagggacagaacatttgtctctggctgactacaagtttctttatctaccttcctttcaaatctcctgaggacagagactaagcaaagtttaccttttgtaatcccccaagtctgtctggtgctcaggttattcagtaaacttcagtaactgaggtcagatggtagaaggaaggggaaaaaaacgggaatcagaggcctgtgtttccagctcaacttccctacttgacggctgagtggctttggaccaatcatcggactcctctcctcgcctctgttttctcatctgtgaagtggaaacaatagccaaccagtctacataacttaatgttgtttccaatgtgccttctatgaggaaggagaggttatcagcagcaaagggatagacacatctgagggcatcccttatgctgttaatgactgtttaattgtcatagaatatggatcactgccattctttgcttgacataaaaacaactcagagacacactgtcaccgtttcagagagcttcagaaagaatttggattggagtgcttctttcatagccagatctcatgtagtaggtcattattttgtttctttgattaataggacaattcggttacaaccgaaggtactgtaaccctgcaaccctagagaggatttgcagggctgaggaagagtaaattcctattagcaagtatcttggtggcaagcaagatggcaccttggtaagaagttatccatccaactcagcactccaaagacctgcataccagtgtatgcgggaaaaaccatagccggtctaacagggaggcgccttctcgctcagaatcatctacaatggatatgattgtaattgttgaagaagctacagctgcttctactgagagcaagcctcgctcttctgtttttcagaattataaaaatggagctaaacagagataatggaagttgcttttggagcactatcttgcagactgtctttgcacaagatattgacaggaaatgtctgcacgtttcttagagcctcctgaatcttcagcatctacttttttttttttttttgcctgacatataccaagcacccaacacatggttgttcatacgaatgaatgaacaaatgaactagtagactaaaaaagaggcagctcttgatccccaaacattgtggagccaaaacactatcctttgacagtgatgaggatgggagaaaagactgtcatatcttaagaattaaacaaaataggccaggcgcggtggctcacgcctgtaatcccagcactttgggaggctgaggtgggcggatcacctgaggtcgggagttcgagatcagcctggctaccatggagaaaccccgtctctagtaaaaatacaaaaaaaaaaaaaaaaagttagccaggcacaggggcgcatgcctgtaatcccagctactctggaggctgaggtaggagaatctcttgaacccggaaggcggaggttgcagtgagctgagatcacgccattgcactccagcctgggcaacaagagcgaaactctgtctcaaaaaaaaaaaaaaaaaaagaatcaaacaaaatagaaaagcaatgaaatgttttaaagaaatgactcttacttaaaagacttaagaaaatttacgtagatacacgtgagcagtagaaagtaagaatagctcagatttatttcacaaacatgttttgagcatctttgtgtgccagccattgtattgaccttggtatacagtggtgagcaaaccagccttagacctagagacctggggcttttgtgtagtgggggaaaatgacttactattaaatgcatgatatgaaccgaagtggagatactgagggaaaagattgaggctctgtaaaagcatccagcagaggaagcataggctggaagaaggcttctcggaggaagtgaggcttgagcttacatctgcaggaaaagtgggagcattccatatggagagcaaaggccccacggcagaaggagcaggaggtgtgtttgaggaccttgcccgaggctggagccctggagtgtgaaactgagggggaggtaaattagcagttcctgtagccaaatcctggtctgttatttctgaaagtctgtcatctctgaagaggatactgggcataaatacaaatgagaacatgatcttttaggtggtgagagtctatagagcaggcatttggagggatgccctctccccattgtggaactagcagaacaaaatctaaagaatgcacaaaagaaaccaaaaaatgagctgttaggttctaaggagggagggagtgtgatggaaagcacaccatgagaaataaggacatggacctgcccccgccccatcatgacactggctgtgtctgaaaaatggagcaggaaaggcagcgtgactaggaaaatgtgcagttttaattttacataatatttgtttttttttagaaaatattttctaagataaaaaatgctaacatttgtgaatagtggtagtggatacatgtgtatgttttattattggatttttttctatatatcacatttttttaattagaaggggaagacttttttttttcttaaattagaagaggggcagttaaaggaaggaggtaggtgctaggaatggtttaagagtcagggtcctattcctagatacaaattggcttgggcaaattgcttctctggtcttcaggtgtcttatctaaggagaagagttttgaagatgatgatgttggaaatcccttctagctctagaacgttctgtgatcctgatttttaaaaacaattgatgattgaatagttctatttataggcttgggaatttggtgtctcatgctcactaatccctgattctttaaaattaggagaaacaatcttgcttggcacaagatagccaatagctttctagtcaggaagctcgtgcattgaaattcatttgcccagagacattttcaaaagctgtgaacccacaggtcgctgacatcccttctggaccagatgtgggaatctggacccacccagaaagctgtgcctctgtgtcaggcatcctgccattcaccacacgcgttccagcggctgctctctggctttgcagggcacctgcaggacagtttgtgcataaggaatcccttccctccaaattttagatgagaaatatggtaatgaaaggaaataacccaggcagagtggcttgtttcacatgtcacggtgtgtcaaaatcagatgtatgtcttagattcttgggggaaaaaaaaagttgtcgcatgaatttgggggttttgttttgtctttggacatggtccgggaggcatgatgcgcgccctggagcttcatcgatgctgttgagtggggatgacggtgtgcatcgccacatcctcagctttccagttgtttcagctgcgccctccaagctgccctgttccgcggggacaatagcagccagtggacgggagcccgcaccacacagcagcaaaggaagccggaggagaggctctgcgggctctctgctccgtcagcaggaatgtcctccgggccagcagctgcctttgcagccacctctccagtttctgtcacttgggtcaagtttccttataatgcgttaaatgaatgagaataagaaagtgtgtgttggcagaatttccgttgaataatgccaaggctttccaagtaagagcatgaatttaagcggagcaaagttcccagtcaatgggattcagagtaatggctattctgctaataatgaaaagtagaaatgtttttacttttaaaggttcacaaatgggctactcttagggctcgctggcctattcagttacaaagtggaaactgttccggatctttgctttattgcacttgtatttagtaggtgattggaaacattttccacttagcatttaagggtttgaatagactggtgactttttttcaactaaagtttcctcttttttaaaaaactgacatttttctttttttgcaagtagactgaagatttcaagtaacaggttttccaaatacttagactctgcctgcataattattatatttgccgtggggattagcacttttcaaaagtgtatttctacacaacatccttgttttgccccaaagtttgattcttcacagcttattacgtagatttaggcaaaatggaccgagctccatccactagaacttccattataaaggcaatcatttcgaatgaaacagaagccatttatcttaatgaaccagcaggaaaatgaagtctgttgaaatgatctgaacccttcaaaaaatattggtaattcattgtggctatatttatttttattagtttctctatgttgcctgttttattgactttccacagcaaaccaccacccccaccagcaccaccaaataccgttgtattttgattccttatgttctttattagcaggcttacttctctcttcatagaactatgcctttgccccactgctccatttcagagcattcggggctattcctggtaagaagccagcattagttaatgttactgttctggtcttgggctgcaaagagtgcatggataatggttcatgttttcccctccaaatggagggaagacacagacataattgaaacttacaatgtcgggggataattttataccattatttttaatgaaaacggggaagtatcctagctaaaatgctggaaaatagccttccagtagccctaagcatccacgtgtaactgaatgcaggtgggatagaaacctgttccctcttgcctccctcccccaaatagagagatgctgtcagtggtcaggaaaagcagtgagccacaggtaatgagctccgtatccattttctttgtcagatctcccagctgatgacagagagtagccgggagggactaacagaagcagtgctgaaccgctacaatgcagacaagccttccgcctgcagtgtcccagcctcgcagggctcctgcgtggccagcgagacttccacaggcacatcggtggccgcctccttctttgcacggtaagagagctgttcagatccttggttctttccgatgagcccagctggttagcccctcacgtggactagctcagctgaaacactagaaagagtttggggccgttctgtgatgtcattcattaagacagagtttctcagccatggcactgtgacctctcgggccagctaactgtggtggggactgtcctgtgtgttatagggtgggctgcagcatccttggcctgtacccctcgatgtgtgcccgcagtaccctcctccagtcgtgactaccaaaaatgtctgcagacattgtgagaggccccagggtcgagagtcgctgctctcttgatgtgtagctccaaagatgctcttttgcagcatcaggactttgtagaggcatccctctggtgggtgtttccagatttatcttctcattacagaaattgaactgcttaaaagctattaaatagatggcaggttttctcccccgcttcttgacagattagccagagtgttatcaaatactctccagctaatcttgggaacttcaaaaatacaagaaacaaaaaagaaaggtatttcaacaatgttttctgcctaattttagcaacatggcagagacggggcgggagacgaaggacagctgagcaggaaaggacttcagggattgtctggttccatctccttatttatgaatgaggaaaccgaggaccaggaaggttcaactaggagtgagtttatagcacagccagaaatagaaaccggattgctctacatttttctgtataactcatgttttaatttaatgctcagaactgaaccttggaaaactttctctgtctaagatttgcaagctcctgagtaaacaggacatagaataaatgcgatagcatcagatacgaaatcacaagaccttttgggttccagttgcagcagttctgcctcagtttcttcatgtataaaatgaggatgatacctgctctgcagggtcgctccgaagactaacataagatgatgagaaattataaagtactgtagaaatggttactactatgtcagtaagaaggaatattgtgtggctttgcttgttatctttatgaatggtaacatccagaacacaaatatggggaaggggctctgattaggacagcggcaaggcagaggaggacagagggctaagaccctggatgatgggaccctaaaggcagcacacagggcttgttggaagaccggctttgagggtcttcattgtattttggtgctgtgtttattgtcgtatgaacacttgggacaacttgaatgtgtgggaagtaataggaaatatgtataggctggccacccaacaatggggaccattgtgttagccctgtctggacatgaatctctgtgttgtcccagaccattaagcagggagtccaagctcactgggaggtcatgtccatgccatttagggagagaataaagacagggaacagttatgaggaaatgtcacaagcacagaagctcctaggaggttattagaacatgttcaaaggaggctgactaagaagccatggcatggcaggttcagtttggagaagagaaggactctggggtacatcatggatgccctcagctatctctcaggctattgtataaatggagacttggttcgttctgtagagcaaccagttatgtaggcaaaggctaaataacgagggaggagacggacctcccagctcagaatgaagaacttgcaattccgatggcttcaggagagagtgagatttgtgtccctaagggagatcaaagttatgttgagtaattacctggcctcgatcctagagggaacattcaatgctcagatgggaattgacttccgacgtgcctttctaacctgaaattctttgaaagtggagtcttccgttcagttccagccagagaattttacagaaggttgactgactcacaaggcaacccagaagatttgaagcaggaagaaataagaagtgagggttcccaattggcagaatttaaggagaacatgagttctccttaaattcttggtgcgaggaaaccagcagcgtctttggagctggggaaaggatgtggaaatgaggggggcctgggaacctcatagtactggacaaggtgtgcctgaggccagaggtcaggatatcagaggaggatttacgaacaagcaaacacacagcagggaaaggaataacaaatcactagcgaaagcctagggtggaagggagatactgaggcaaaacccaaaatgtatgggccagtgatgtcaactggggcaggctctgcaggtgatgctagcagcaaacaaagacttgaaactcatgacttcagaacgacaagggcttgcagtatgagctttcaaagagctggaaaggatccctaaggctccccaaatctttactattactttctgtgcagtgaacgctgatagtacttggagcttcatggtataagcattaaaagtatgtggtttgtattcaaagggtttacaatgtacagtgggaaacaagtaccatgtgaaaaagaacaattctttctatagatttcccccccaccctttactcattaccatattttgccatgttattctcatcattattgatgagaactattattagctgggctttcccacctcccagcgagggaggcagcatattaataacccccctgtcactgaggggcacccaaagcagaagtgtgactgactggctccaggctcatcctgtcaagaggcagaaccagggatgtacctgacagttaggtccccaaacgtccatgtgataagccaaaacctgcccagcttatgctgtcagacagtcaactgagttcaaagagccttttggttttagctgaagcaaagctgtgtaaggggatggtaatgacagcttttgataagtgtctgtcctcataggggtttggggcagagtcagctcctacacctccaatctgtgctcaccactttccactcttcctgcttgactgcaatggagagagagtcctctgagtctgcggggccctggaactctcctatagctccaagtcaagacacaggggtggcctgctttcaggaagctgtcctgggctgggcatggtggctcacgcctgtaatcccagtactttgggagaccaaggtgggtggatcactagagaccaggagttcaagaccagcctggccaacatggtgagaccccgtctctactaaaaatacaaaaattagctgggcatggtggtgcatgtctataatcccagctacttgggaggctaagacatgagaatcacttgaattaggaaggtggggtttcggtgagccgagatggcgccactgcactccagcctgggtgacagagttggactcagtctcaaaaaaaaaaaaaaaaaaggaaagaaagaaagaaagaagcaacagctatgctgggggccatttcgttttatatgggagggatggcatttgctaaatttgtggccaatgtggctgacgtatattgagcactgagtgggcatcactcactattaactacctcttcatatgcaaacccccttcatcttcacagtaaccctgtgaggcagagcctaccattttctctgttttatggataaagaagatggttccctgagttactgacccagagccacatagccgggagtggcggagtgggaaatccatcctcgtttcctctcacttgagaccccaggttcctattctctgtgctaaacagacacaggaagacactttattatagggttttttttttttcaccgtaatcatgaactgatgattgcttataaaacaggtgtgaaactactaggccctgtaatttgtttgagaaggtgagtagaatgacaataacaaaaacaacagaaaaacccccaatttgttgaagatttgaagcaggaagagataagaggtgacacatttgttgttgctcttgaggattcctacctttacacggtgttttcctgttgacgaaaaatatgtctatcctgggtctggaattttctggataaatgttggtgttcatctccatatagcgtcgctctcattcatgcagatgtccacttttctctgtgatattaacctttatttaaaatgtatttatttttattttaaaatcttttttttgagacagaatctcactctattacccaggctggagtgtagtgacgtaatcacagctcactgcagcctcagcctcccgggctcaagcgatcctcccacttcagcctcctgagtagctgggaccacaggaatgcaccactgtgcccagctaatttatttttattttttgaagagatgagtctccctatgtttgttgcgcacgctggtcttgaacacctaggctcaagcaatccttccaccttggcctcccatagtgctgggattatagtcatgagccactgcacctggcctaaaatttattcatttatttatttttgagatggagtcccactcactctgtttcccaggctggagtgcagtggcgcgatctccgctcgctgcaacctctgcctcccaggttcaagtgattctgcctcagcctcccgagtaagattacaggtgtgcaccaccacatcagctaatttttgtatttttagtagagatggggtttcatcatgttgcccaggctggtcttgaactcctgacctcaagtgatccacctgccttggccccccaaagtgctgagtattgttttgattgactaataaacattgtatatatttacggagtaaaatatgttttgaaatatgtacatattgtggaattagcctgtgtttttaaatgcttactttctagaactgtgggtggaggtctgggtgaaccttgttacatttcaaattcaatgcctataaaataagaatttcaattttgaataagcagtgtgtggtctgtgctggtccacacacggttactggtctgtgataagtatagaaatggagaggaagcgtttagaaacatctgctgatggaataattttctgtctgttgaatctaagaataaaaaatcggggcttgcattttgtgtataactagaagtaaaagaaaaattggtccttcacccggatagtttgagatgcactgctatagagaacgatggagcatgaagcacctgttctgtgcttttcttcctctcacgattgtctttaaatggtcagcatcttagtagctgtctttgcttcagaatttcagtaccttccctttttttttcgagaaaagacactgtttctggaaaaaatagtaacagtcacccagaaaagagatcgagacaactgatcgtcaagttggttaactattatgtgctggctttgaacatcaagaacatttcaaacgagggccttttttttttttttgcatgattttcacattaatagaaaatggtgaagtagggtatcattagattttcccatttgctgacagttcactttgaataaaggtggacttaatgatgtactttaccttataaagtatggagtacatgaaacccaataaaaactcttgggtgaaaccctagctttgtaggttgaggcagtggaaccttcatgtatatttgaagagcagttagtggattctggattatgcatagaattgaaccctgaaacagaaaatgaatcttttgggtgacctcatatctttgcattgattttctttcccaaataaccattaaaactcatgggttttgtttttgttttttttgagatggagtctcgctctgtcgcccaggctggagtgcagtggtgcaatctcggctcactgcaagctccacctcccaggttcaagcgattttcctggctcagcctcccgagtagctgggactacaggcgtccaacaccacacccggctaatttttgtatttttagtagagacggggtttcaccgtgttggccaagatggtctcgatctcctgacctcatgatcctcccgcctccgcctctcaaagtgctgggattacaggcgtgagccatggcgcccagctgtgtttttttattcatggagaaaattagcttctgtagaattttcatctacattcagagcaagagtttgaaaaatggtgaaaatggacaaagatcacatgagcacaaagacactgtcaagttttggcagagctggtatcgccagttccatggcgttggtgagcacagagacttccagttctgccctcagacatcacttctaaattgtcatatttttggtgttcagcttttatgtttagttgacagcctttctaccaaattctaatcagatttccaagtaaaattatattaagggcattttttattttccgtgattttatttaaattttcctgttttcttaatataaacaaatacctttccattctgttatctcaggttctgatgacttcagatcagaacttactatcttcaaatcctttattctgtttttttgctcattattgactctgttacattagttagagcttctttctctctctcccccttcctctctctccctccctcctccctcccttctttcctcccttcctgtttttccatctgctcttgaagattcctacctttacacagtgttttcctgttgacgaaaaatatgtctctcctgggtctggaattttctggataaatgttggtgttcatctccatacagcgtcactctcattcctttctctgggatccctgttgtctgctttctcttccacacttgccaagctgtccctcactttctcccactgactcctctaactccttgccgtcggcccaaacacattcctttctcaggacgtgattgtttttctgtccatctcaatctcttgtgtggtatcttccatcgttgtttttgaatggctccctgtgttacctgaacagcattcttcagtcctcttgagcatgtcactgactgttgtatgactgatttgaccagtatccccttgggtccagaggttgccgtagtgttaaaaccaagccccgctcaggccctggggtcagggctaggctgagcagagaggactgacctctggctcccaggccctgccttcaggaccacgtggcttctcttgttagttccctgtggggcctgctcttcgtgctgtgtatcctcatgtgaccatacggagagctgttactggtctgatgaccattattgccgcactctcgctgagaagcaactcagatagcgccttgctgtgatggtttcagcaaatgcttttcatatatgatcttgtatgatgaaggctttctttagtccctgggcccttaacagtggtacttggttatatgtttggagttgatgaagtcagagaaggatgggaaggagcgtggaactgttcctgcttcttttgttcttctgtcaggtacagttccctttagggatgctcccttcttccccttagaaatacatcaacaatattaccagagaaaaactaccctaaacataccacaattggtctcaggtgatctaggcggaggaaaaattgagctgggtgtctgagatccaactcctaggcgtcaattgactgtggagagacagggcacaagttctgcctccagtttcacaacttggaacagttaatgtccagcactgtttccattatgatagaatgatgcctttacaaaaacaaacaggccaggcgtggtggctcacacctgtaatcccagcacttcgggaggccgaggcaggcaggatcacctgaggtcgggagtttgcgaccagcttgaccaacatggagaaaccccgtctctactaaaaatacaaaattagccaggcatggtggtgcacgcctgtaatcccgtctacttgggaggctgaggcaggagaatcacttgaacccgggaggtggaggttgcggtgagccaagatcacgccattgcactccagcctggacagcaagggtgagactctgtctcaaaacaaacaaacaaacaaagaaaaagcccttttaggagctcatattgtagaacttcactgtattatttttttttcctgtttcttgttttgttttcactgaagcatattttgcttacccttagttccttgcacttgccagggtcccgttctgacttggtgtctgttcttttctccttgccccagtgtatcccctcgttctcacattccagatctcagtctgcctattccaggacttcccatggaagcagggctaccattgagcttcctgtgggacacttgtggtcggggccaacatgcataattgtgccatctattcacagaaccagggcgcccaattgtaggagtgagtggggcttaaatccagccaacactgtgccagcctggtggaaccacctcctctggggctctgtcaatcctccttggatgcaggtaatgtctgggctcatgttgtcctggccggccctgcctccttcactggtggccaagcagtgtcaggacatagatctttgaagggctgaactggaaggcaaacccctaccctctggtttcttatttatttatttattcctgacaggtcgtagctttactctgcttagaaaatactccgttgatttcttggaaaagaagggactctcactcatgtatattgatgaagtgaatttttaggaatcatagttctatgaatatggtctcactttaactcaccttatgaaaggaaaacattaagaagcaaccaagggtatatttagtgccatccgatttcaagggccctagaaaacagtctcaggcatttgctgtgtgaagctgaacctcctcagttgcttatgagacagcgaaagcacagaaggaaaagtggttgtaatttaacgtctacactgttttcccttctgctaaaaacatgcctaaaacacctcaaatagataaccctaacatccaatatgcaaccccagcaacccccaactgttctgttgttgggggtgcagtccgtaacagaagtggcattcatagcttggcacacaccactctgagatggtgagctacgctaaagaaaatgaccagcgtttgcggccccttcccatcttctgctgcagggaatgtggtcaggtggagcattttctgattaaacaagtcctttgtctgactggcggccggttggggtgttggcaattggctcccaacatctgggaatcatttccacggctttgcctaggttgaaaactcagttcatgtcttgatgtgaatgtctgaaggcaaagcaatttcaacaagcctcaagaatcccagggattcttgtaagatactctcagggttaaggattctagttcttattgcacattttgcattttttgttttaattgatgctgtggtgggggcgggggtggggggcagtggttaggagagaaggatattgaataagcaaacagaaagctggagaagcccaggcttgaattctcagccagacactgacattctgacttgaggcaagtaacttaaccttgctaagcttccgttgcttctgttcaatggagatcatcatatctgctttataggattatggagaggattaaatgaaaatgtgatagtccttggtaaacttcatccaaatcctacagataatgtgaagatggcacgtgctataaaaaggatggagttctgtcctcaatgaattctcaacgttcccttttgagtagatgacttttcgttgagacctttacaggctgtttaggtggccctttgttatctgtctaacgactgtccaggccttctgtggcaattataaagatctggtatcatgtctctgagaacaaaaaccacctacagaaggagctgaagagcaattcgcccttaaatctcacctgttacgaactagatgccattggtgatggaaaatatcagtgacccatacggagagagaaacctgccctcaagtagctgcattttagcagagctccaggtaggtcactgctcacctctaaatcttctgaagaggtttcatttttttgttggtttttgttttgttttgagttgcagtctcgctctgtctcccagcccagattgcagtggcacaatctcggctcactgcaatctccacctcctgggttcaagcaattcttccacctcagcctcccaagtagctgggattacaggcacctgccaccacacctggctaatttttgtattttttagtagagatggggttttgccatgttggccaggctggtcttggacacctgacctcaggtgatctgcccaccttggcctcccaaagtgctgggattacaagcatgagccactgcacccggccttgttgttgttttatagccctagaaaaactggtaccaaacaataaggaagagactgaagggaaaaaagaagatggggaggggctttaagaattctgttcccatagaactttgtgactcactgaaggccagcaagctggaattgtcgtgatactcacagtggacattaacgaaaacagtgaataaaagtaaaaggggaaatgttctttctttgtgaataccctcgtgatctgaactgggggctgaagagggaggatggggtgacatggagtagattcaggaaaagcagagtagaaacctgtgaactgaaggagaggaccaatggatgaggagaggatgcaattttatctagtatatgttgcgtaaatttgtttcctggtctacacttctaccaccaccctaatacagtaccgctataatatgtttccttccttcagcactgactcatttaaaaatcgtactggccagccaggtggtgccatggctcacaacttgtaatcccagtactttgagaggctgaggtgggaggacagcttgaggccaggagttcaagaccagcctgggcaacatagcaagaccctgtatctggagaaaaatttaaaaaagcaaccaagtgcagtggcacatacctgtaatcctagctacttgcggggctggggcaggaggatcgcttgagcccgggaggttgaggctgcagtgagctacgatctcaccagggcactccagcctaggcgacaagagtgagacccttctcttagaaaaaaaaataatcataatagcctacatttttgagggcttcttatatgccacacactattctgagttcttgacacacatttaatcttcagaagcccccatgagttggccgtgtttttatcccattgtttagacgtggaaactgaagcacagagggcagaagtaagttgaccaagtccacacaactagtaggcaacgcatagggatccgagccaggtgtctgattccagaggccacaagccagaatataagctccaaatataaggtggggacatttgtgtctttgttcttggctgaagctccagcacctaaaagaacactcaagaaatgtttgttgaataactcaatgatggtcttagccaccatgctctcctgcctccaaactcaagatgggttgcaatggacaggggtcattaactaagcagtctcaatgcaacgatctcaatgtgagaccaaagtagagaatgggtacaaagtgcaccacagaagctatagggggaagcttttggaacaactactcttttttttgagacagagtctcgctccgtcgcccaggctggagtgcagtggtgcgatcttggctcactgcaacctctgcttcctgggttcaagcaattctcctgcctcagcctcctgagtagctaggactgcaggcgcccgccaccatgcccagctaatttttttttttttttttgagacagagtcttgcattgtcgcccaggctagggtgcagtggtgcgatctcggctcactgcaacctctgcctcccggcttcaggcgattctcctgcctcagcctcccaagtagctgggattacaggcatccgccaccatgcccagctcattttttctatttttagtagagacagggtttcactatgttggccaggctggtctcaaactcctgaccttgtgatctacccacctcagcctcccaaagtgctgggattacaggcgtgaaccactgcgcccagccaatttttatatttttagtagaaacagggtttcaccatattggccaggctggtcttgaactcctgaccttgtgttccacccaccttggcctcccaaagtcctgggattacaggcgtgagccactgcgcctggcctgaccaactactgtttatgcttctaattttgttagttactaaaatatcgctttcagtctcatgcagtaaaagcaaaaggtttttcagtgacttacaaggctctgtgcacaccatctgtcccctgccctcttcctctgccatgttcccacttgcttactctgctctaggcatattgacctccttgcttttcctctaaaagtgccaaggccattccctccccctaggctttgttcttctgcttggcttaaccagaccttccttcagatctttgctcaaatgccacttccttggtaaagccctctgtgacctccctgtttaaaattacaataatcccacctgtgcacccctccctctcgcgtggtacctgctacattaggaatatttgctgaatgaatgaatctcagacaaatgggagatgggcggctaagtctccagattgtcctgcattgaagtgcttggagaagtttgcgaattttcccactcagttcaaaccacatgctcaggaattaaagtgttctttcagctttcagatgttttcgggggatagcattgtaacaaagcatgaaaaaaagcagtgttgggaaattgagattcttattacagtgggagtacctggttgtcatttcaagatgaggatttgttaagggatgggacaagggatgctgcctgggacaataaaccaaagaaagatttaaaacagagaaaagagttattagttacaggactagcacaaacaaagtagggctctccatctttttcctgtctcgctgaaaacccatcttttcttcccttgaataaacttctttgctttctgtccccctgctttgatttattattttaattctatagctgtcttcgtgaagtatgtaaagcatttgggggtaaaatcatgtggaagacattatagaaactaaagatgtgtgatattatgtggtgttgggtagaggctcagcgtgcttatgaatcacacggttgatgaaaacaccaatctgtccagggccattgtctatcagctgtataagaaattggctcattgttgagggtacaagaaggaggaatgtaagggggactgccggaataattcggttagaattcggtaaaaccggagcatggagaggtctggttgacatccctcctttttatactgagagatgtccctgaaggtgaggtttttattttcttgcctctaaaagggaaataatgaatgtttctatttcttctgtcctattactctgtgatgaatgcttcttttatttttatctgagtctaactccctccaccatacttagcatcatgcttgcatcatatccattaataaatggatgttgaaagaatgaatcaaccatgcttgaaaacttagatctctcttgcttttcaagagactcaaatatttaaaagcagctatggagccgtgtgcggcggctcccgcctgtaatcccagcactttgggaggccgaggcaggtggatcacaaggtcaggagttcaaaaccagcctggccaacatagtgaagccccatctctactaaaaaaaaaaaaaaaattaacagggcgtggtggtgggcacctgtagccccagctacttggaaggctgaggcaggagaatcgcttgaacctgggaggtggaggttgcagtgagccgagattgcgccactgccctccagcctgggtgacacagcaagactctgtctcaaaaaaaaaaaaagaagaagaagaagaagaagaagtaagaagttatgggattgtgcttgcaagcagcacagtttattgtgtagcatcagagttttcatcattccaagtattagtgataaaaataattctgaaggataaatggcatattttccattgttgatttcaacacagttagactcagcagtgcaccatttctgataatcatctatcattttactcagcatatgcaaaaaatgatcttagcatcacatggcaattagatgcttttttttctggcacctggtgtgcttgttcatgaagtgcactgagattccggaaatataatttcaaaagcctagaaataatggcccatgtcattttcttggcattcttcaaaaccaaagccttaagagtccatggtttgtccttttaaaccccagcaacggaaagaaagggccttggcagtgacaaagaaagagaaattctcttgggggtctgtagtgaaaagggatgtaatcagtaccaggcaagccactttgattttttttttaaaaaatgaacaaatataaaccattactcaaaatttctttccagtctttttggtgcttcagaatataaatgtggctcatttttctctaataagtttccatttattatcatagtcatctcttcagtgctcaatcaaagtggcaaggttgtatttgtggagaaaacagaatattttgtaacatggctatcctgaattttagaggcacttactagggatggaaaaactggtctgaagttcttaggcatactcttaccacctaaaagtgttcagcgataaaaataattgctttgtttttacctttgaggaactccaagtatcaggttaaaaattgagagaggtagtgaaagagagtcagtgattccagtgtttcagaaagtctgacctggccagggtccagctgggctgcaagaacctcctttctctccctgtctctgcagctccatcactcaccattctctccaagtcccttgggaatacatggggagaacctagtggccatagcagatactgctggtccccctcttcccccactccttgccacctcatcatttgcttgcacaaaaccttatggttctcaaggcccagcacctgtgactctgcccgagggtttcctctggctgtgggagccccctgcacccacacagggggcaggccacttgggagcaggcccaggtaagactggcaggagttggtggataaacaccccagctctcttgtctctaggtggggataattctgaggcatggtctactctgtctcccatatttccctggcaggattgagccccagttgtctgtgtccataacctgcttgagaacacagactctggtatcttccttccttcccttctcccttcctcactgtcttatggctgttacctagagtcacctcccagttaacctaccagcaccctcatccttgtacaaggatatgtctgagggaacttggtataagatattggaagtatatgctcttttgtccatccatccatccatccatccatccatccatccatccatccatctctccatccacccattcatccatccatccatctctccatccatccatccatccatccatccatccatccatccatctctccatccatccatccatccatctctccatctacccatccatccatccatccatccatccatccatccatccatccacccacccaaccatccaacaagcatttggtaagctcatgctgtatgccaggtattgtgttaggcaccgaggagagcaagaggacagccaccgccctcagggagctctcagtccagcagggcagccagtcccaggataggacagtgagaaaggacatggaggttcaagacagaaaaattcataaagccatccagtatggcttttgctctcccggtgtcttcaggttgtttaaaaattaaaggtggctttccagcacctattattatcagaaatggtcttattggttcacttgcttactagtccattgcctgtctcccttcctagaatgtaagatccatggaaagaggtacttgtctagcttattccatcattgcttcctcaactcttagaacaggggccaggctggcgcatgataaacatttggtaagtgcatctcatagtcattaaggcgtctgctgtggaaagtttgtcagtttcctcctgttcctcccggagtaagctcatccatgttgaaatatacccaagctccactctggatgcagtgttccagtgcactgtggaagtctctgctcaggacaggagggatagcaagtgtgctgcccaccctaggtccgaggtggccacttcctgctagccactgctccttgggaacaaaggacacttgcccaagtgtgtccctaaggtgagcgctttagcatcaagaattattcaactgaaaggagttggccggacccagtggctcacgcctgtaaatctcagcactttgggaggccaaggtgggtggatcacgaggtcaggagttcgagaccagcctggccaacatgacaaaaccccgtccctactaaaaatacaaaaattagccaggcgtggtggtgcgcacctggaatccgagcgacttgggaggctgagacaggagaatcacttgaacctgggaggtggaggttgcagtgagctgagattgcgtcactgcactccagcctgggcgacagagtgagactctgtctcaaaaaaaaaaaaaaagagttttcttctaaatagcttgctgagtttctctattttctttgtacactgaattctaaactctcagttgggagattctgccaatgaaacactctttgcagtctcctacctctgctacctgggcttgcttgatgctgggtgatgaaccacccaggtacctacacaacaccctggttgtcagcagtggcagtggaaaggagagtttgaatttggaatgtagacattttgtaaacaggttcagagaagtaactgcccaccgtcctccccactgtggtgtgcaaagctaaagagctgactcatgtgatcgtgggggttggcaagtccaaaatcggcatggctggagattccagcaggagttgatgttgcagcctggagtccagaggcagtcttaaggccttcaactgattggatgaggcccacccacatgaatggagggtaatctgcttttctcagagtctactgactttaagtgttaatatcatctagtaaataccttcacaacaacatctagactagtatttgacaaaacaactggacaccgtagcctagccaagttgacacataaaattcatcacctcaagaatcagcactaggtttaacatgaaaacaacttgtatttagtgcaatttatcaagtgcatattgagactggctgaggttcttcctggaacttacttctctctctcactttctccctctcttttttttttttttttttgtgagtcttgctctgttgtccaggttggagtgcagtggcatgacctcagctcactgcaacctccacctcctgggttcaagtgattctcctgcctcaacctcccaagtagctgggattacaggcacgtgccaccatgcctggctaatttttgtaattttagtagagatgggattccgccatgttgcccaggctggtctcaaactgatggcctcaagtgatctgccagccttggcctcccaaagtgctgggattacaggcatgagccaccgcacctggcccctggaacttatttgttagtattcaggctactgaggtgttgcacctgcagactctcaggtggcactcacccattctctctctctgccgagctcccgtgttccatcctttgttcctcagtgtccccacctgttaacgtgttgaatgtaatccccgtgtcttttggataaatcagagaatcccatatcatttgttacttaggatcctgagcattcagttttagctttcacactaaagatagagaaaataaaaatagataccattaatctttacacttctcctgtggtcctgattgccaaccatagtctgaaagatctgcagtggatttattactttgcatgttctttatttcctttaaacccgggcgtgtgaggaacgttgatttatggagcctagatcatgcttggctggggaatgggaggagggaagcaaagtgttgttcaagctgcagtaaatttaaacatcactagtatttctttacacatgcaagggggaaaagtcctaacttaagtccattgctacaggagctcataaattaaaaataacaagactatttcctatacacctggagcttcaaaattacatgccgttaattctttgattgcccccttcacaaaagagccattgagggtgacaactcaaacaagatctccaccacagccgtgaaatccaatcagtgattcaccttgtgtctttgaccttgttcaagataaggaagtgacttgtctgaaacatagactctaagaatttagtcccattatttttttcctcaaacttttccctctcattactctcttctctctctctcctctctcgttttattttttctaattttacataaattttaaaacaaatctaacagcatcagaagaccaaaacacaggaaagtcttcttgactttccactatgttctgagccataaatcctttcgtgtgctcaaataatacaccccagctggtctgttggatgaatttggttagcctcttaaatgttttagcacctgtacaccacagagctcccaaaagcgaggaaattatgtttcctcctgtccccaacggattgcttttcacctgggccatatagctgctgtgtgccactttacagaggttaagactgagcagtcctggaggacacagaaagctctaaagaagtacagacacaacttcaagtcctcatatattttacttcttcatcttgttctttgagaactacgtttactttctttgagaaaatgcataaaggagaaagagaggatatactttattttgatttttagagaaccttgaaagtgtcatgccagaagcggtggaattgagttttcactcttataccacccagacctttcactctaggtatataccaaagaaaaatgaaacgaaggcgtttgttcacgtcgagacttgcccgtgaatgttcatggcagtgttattcatcaaagcccccaaaatgtaaactacccaaatatccaccaactgataaatgaatagacaaaaaaaacatggatgtccattcagtgagatactcttcagaatcctcaaacgattgctacacgcaacatgactgaatctcaaataatgatggtaagcgacggaaaccagatcccacctctacagatggaaggctacatatgctgtgatttccttcagtgcaggatagacaatagaaactaatagagtgacaggaagcatatcagtggttgatgggaagtgagggtgggagggaggaaccgattacaaagggctgtgaggaaatgtttgggggtaatggatttgcttatgatcttgactgtgatgatttcacaggtggatacatatgacaaaactcatcaaagtgtgcagtttattatatatcagttacatttcactaaagccaataaatgatggccaggcatggtggctcacacctgtaatcccagaactttggcaggccgaggtgggaggatcacttgggtccaggagtttgagaccagcctgggtgacatggcaagaccctgtctctacaaaaaataaaaaattagccagacttagtggcatgtgcctgtagtcctagctgctctggaggctgaggtgggaggattgattgagcccaggaggttaaggctacagtgagccatgattgtaccactgtactcgagcctgggcaaaggaacaagaccctgtctcaaaaaaaaaaaaaaaaagaaaaaagaaaggtaataaatgaattttgttgggattagagaaaatgttttgagatggggcgagaattgtcttaaaaagtaaatagagttgcaataagtggtcgttttcctctggaaggaaaagtgttaataataggaacccctatgaaatgtattggattggcctcattaactattttttcccccaagggctcaagataagaaagtaccacgggaaatctccaaattggtacacaaatctaaattattttaggtaataaaaaatcatcaaagtagaataaacgggaagaaatgagcagaggagctttaatgagagcaaggagaaacattttgggtaaaataattcaaattattcttatgagatgatagacttggagaaactgtttataattgaggaaggggatgtaaggactttgttgccagaagattcagcctaagatcaccaggagtaactaaatgtgttggacatcatcggaaagaatattgaaaatattgaaacaaagtgaaaggtaccaccttacccttgggcaaagtgaacacttctttcaacctagaagttcctataaagttctgacaggccaggtgcggtggctcacgcctgtaatcccagcacttggggaggccgaggcgggcagatcacgaggtgaggagatcgagaccatcctggctaacacggtgaaaccccgtctctactaaaaatacaaaaaattagccgggcgtggtggcgggagcctgtagtcccagctactcgggaggctgaggcaggagaatggcgtgaacctgggaggcggagctcgcagtgagccgagatcgtgccactgcacaccagcctgggcgacagagccagactctgcctaaaaaaaaaaaaaaactaaaaggttctcacaagttcaacttataaaagggaagcaaagcctggtgagcgggtagagactcccatttgagaacgggcatttggaagaactccctagtccggatgacaagagctagggtgcaatctgagtagctcatttggcacgtggatagattattcattaagttttggaactatctcttaagacggggaagaagcagccttagggaacaacaaaacaagctgtattccacatcctaagacacagtaccgactgagaatataaatctgcaggtccagattaatccacagatggcaggctgcttgcaagctattagacaaagccaggggtgttcgggagcagatccccaacttctgactccatagagggtcacagcctgcctctcttgcacagaaagagatggaattctcagctaagtgccacaggacttctgtccaatacactagcccttctagtctgtttctgaaatagtcttttctacatcattttttaaagcggtccgttattccgagcacttttatcatgtaacacatcagctgccataaaagcttgaaggtggctgaaagtgggcgaggatctagaagccccttgggcaagtccagattggaaacacgtcatgggacctccttttagggacagtctcacaggcaggctgccgtaggatgacctcaggtgtcccatgttttgggtgggaatgtcaacagagcagatgcgagaggcatttcacccaagcacctggattgtttcatgcctgaaaggaggcaagacaggaaggtataaaatccagatcggtgcagttgctcagaaaagggacaggtgacggcctggcgttctctccttggcttcctgtggaatttcaaagttactgctttgggattgtgaactccagccatctgcgtgcttggaacctggagagcaatccagctggtgtctaccaccgtaattaagaggggtgtggagcatgtaggtgttatacacccctgccaatcaccaggaaggagctgagtgtggaattcacatttgaaagtgaagatgcaggaagcctgatagctcccaaaagaaacggccaccagattttgtttaaaacaaacaaacaacaacaacaaaacacacaaaaacaacggaagggtacactttagaaaaactattgactttttcccaagatatctgtacctcagccacaactacaaaaaagagtctcttcctctgttgctggcatctagtctgctgtaattgtagaattttctgatgctccatggccatcgttgcttctttgtcctccccactatttcatccgccggctcctgggaggggagggttccagttcactcggctaacgtgtgtgagtccgacagtaacgagcaacgcagaccccgggaagaggaacaagaataggacattcctatatttttatgtggagattgataatcaaggctaacaatcctggcagaaggtgaacaacacattaaacagaggggaaaagataataaaatatctcctgatgcttaacaatcgttgggtggaaacattccctggaattatacagctgttgcatttgatggctcataaagcctcagtaaagtccgtcaagggccttttttcttggcgagggaccattcttctcatgcggttatgatagcatctgcttcctgtccctggaagtgcacagaatccacagacactggcagacggaagcaggggaggagccctactgcagaggcatctggccctttgatggcttttgggtaacttctgatctacagggcatcgtatcaaaatgcagactgagatttagtgggtagccagtgagcacttgctaggtgccaggcactggcttagggtatttcattaatcctgacaactatgaggtcagtattaccatttttaaaacaatactatggaaaacagagccctagactccttaagaaacatacccagggcatgcggctgacaagtggcaggctgaagtccccacgcctggtagccttttttctgttactgcaaagatggaggaagaggcgagagttgcttcctgtccgtgctctgggtacgtgtgaaatcttgtgcatcttcttataccgggtgttcaggcacatgtgtgttgagaagggatgctgttttccagaagactcaaaaacaatgatgggggtcctaggtgacttactgttttaggtcggggtccccagaagcagatcttgatgaagtgaggatttctctgcaagtgatttattaagaatgtggtcctcagggaaactgggaagggagtaaaggaggcaggaaagggaaagagacaagccaaagatgagtcctttctcaggcaaaatccggtggacagcggcttttagcttcagcctgaccatactggggaactctgggggtttgtcctgatgggaagcagcagaggtgagcggtcatctccctcactgttcaccctgcagtcatctccctcactgttcacctagagctgtcatctccctcactgttcacctagagctgtcatctccctcactgttcacctacagcggtcatctccctcactgttcacctacagcggtcatctccctcactgttcacctacagcggtcatctccctcactgttcacctacagcggtcatctccctcactgttcacctacagcggtcatctccctcactgttcacctagagcggtcatctccctcactgttcacctagagcggtcatctccctcactgttcacctagagcggtcatctccctcactgttcacctagagcggtcatctccctcactgttcacctagagcggtcatctccctcactgttcacctagagtggtcatctccctcactgttcacctagagcggtcatctccctcactgttcacttagaggagaggtcatctccctcactgttcacctagagctgtcatctccctcactgttcacttagaggagaggtcatctccctcactgttcacctagagctgtcatctccctcactgttcacctacagcggtcatctccctcactgttcacttagaggagaggtcatctccctcactgttcaccctgcggtcatctccctcactgttcacctaaagcggtcatctccctcactgttcacctagagctgtcatctccctcactgttcaccctgcggtcatctctctcactgttcacctagaggagaggtcatctccctcactgttcaccctgcggtcatctccctcactgttcacctagagcggtcatctccctcactgttcatctagaggagaggtcatctccctcactgttcatcctgcggtcatctccctcactgttcacctagagtggtcatctccctcactgttcaccctgcggtcatctccctcaccgttcacctagagcggtcatctccctcactgttcacctagagcggtcatctctctcactgttcacctagaggagaggtcatctccctcactgttcaccctgcggtcatctccctcactgttcacctagagcggtcatctccctcactgttcatctagaggagaggtcatctccctcactgttcaccctgcggtcatctccctcactgttcaccctgcggtcatctccctcactgttcaccctgcggtcatctccctcactgttcaccctgcggtcatctccctcactgttcaccctgcggtcatctccctcactgttcaccctgcggtcatctccctcactgttcacctagagcggtcatctccctcactgttcacctagagcggtcatctccctcactgttcacctagagcggtcatctccctcactgttcatctagaggagaggtcatctccctcactgttcaccctgcggtcatctccctcactgttcaccctgcggtcatctccctcactgttcacctagagcggtcatctcccttactgttcacctagagcggtcatctccctcactgttcacctagagtggtcatctccctcactgttcacctagaggagaggtcatctccctcactgttcacctaggatggttgccgtggggaggaggcgggtggtgaatcccaggccttttcagcggccctccaggcctgcaggttcaagcaggctccagtggcctgagggcaggcctttgagaaagaggctgactgttagaagcagaagcccttgaaggagcacacagaaggggtctgggctaagcagcagcgtggcgacctacacccgcccctcctccgtaccttgcaggaggcagcgggtgctgaggaaatgggaaaagagccgcaagattaaccagatacccgtggtattttcaagcaacaccatctgctgtatttccacagaaagggtgttgattttcctgaattctagaggtggtgttttcatcactgagttcagatgcctttgattgatgagccaccttcaaaccaagtcagcatgaaacagaagcttgggttagttcacgttgtttgatataataggacaaggcagactaacgtctcttgagaatgaagggaagtttttcctacataaacttccacattctctcacaaggtgggaaaataaaaagggaaaatgacgtgaggggttgcccaagacagggatccttcccatctgaaaccatgctgtgacatgaagtgccacagattccaaaatccacgtgtgtctttcttcgaaaccaatagccacgtgtaaaaaaaattatatagcgtataaacccatagcagcaacattttaagtggaaacagatttcttccattttaaagaaatgtcaactgtgttagggagtctggggatccctcgcatacatcccagctgaacatgaaccccaaattcctgtgtaatgtatcgcagaatctgtcctttgctcacttcgtatctgtcatcaatcaacactgcagactctggaagcaagcatgttatggttttactcttgtgactaagcggagacaagaaggcatttttctcctccttgggctgtttggaaagcatagaatgaaatccagggcatggtcatcatgaattatagcgcagccaggctggtctagaatctctcatcttccaggcaaccccagccttggcagcaccatcaaagggtcatggataacaattttaaaatgcagtgaatgaaagtgttcatatgatgctaatggaatcataatttttaaagtgtcctcatcctttagagatatagactaaaatactggcagatgaaatgctatgattatgggacttttgtcacagtaatactacagagagaagtgcgtgcgtgcgcgtgtgtatgtgtgtgtatgcatgcatgtgcgcacgtgggggggatacacatggaataagattggttatggattggcaattgttgaagctgagtgacagacacataggctattctatttttgtatatgtttaaatttttccataataataggtcaaatagatcataagcatagtgtatactcacagatccctccagaagaatctaaatgcccagctacgctggtcaccgagtatccgccttgctctcccaggtgtccataagcccctgccacagggctggtgaggaagcctggctcccagcttgtggctacctttacacccatcactctgctctcctcccagaactccattcctccagtcacagggcccccagcataacaattccattagcatccttccctcccttatttcttgcaaaattactcttatcatgaattccagggactgtgttcatttgagtggcatcatctattactatttcatttaccccatcacatttctttttctcacataaagatacagtcatttgtcacttaataacatacacgttctgagagaggcattgttaggtgattctgtcattgtgcgaacatcatagagtgcacttaacataagcctaaatggtgtagcctactgcacacctcagctatatgatgtagcgtattcattctaggctataaacagtatagcatgttactgtactgagcgctttaggcagttgtaagacagtgctaagtatttgcatatctgaacatatatgaacataaagaaggtatagcaaagatacagtgttatcatcttggggactacagttgtgcatgtggtctgtcattgaccaaaacgttgttctgtgacgcatggccatattaaggtatacactgggtttggctgcttctatacaaggagtttggataaatttcatatagtgtcagtcaaaaaagtataagaaaattaagccaagtataagaagctgtgatttgtcccagacatcatgacctcagaaacagagtgtctgtgtaggtgactgctctacaataggctcaggaaggcatcgtgtctgagggcccaggctacagactcctaagtgtgtttttagcccccaaggccatctccttttggtcattatggaaattctggagcttaattaaaaggaacctagagtgcaacctttagatttaagagtaatagaaagaataactccaaaacctgtttattgtagggcagttaactcttatgtgagctcttcatctcatgatagaaaagggtccctggtggaggggtctgatacaattataattctgctctcccccaatccccaaagcatcaaaatagaactctggcccctctcattatatagagaagcaaatcgttactgtgatcactagggagttcccaccagcattgctgtgggtcctgaaagagaaaaggaggttccatgatttgggaagtaagtttcattttctttcatatttggagagatagtttctgattacagccagtggtctcttctgtaaatataggtgggccatggactctagagactctcaggatataatctgaaggattgattgcatatgaacctgcctacagatgcagctcttggttctgttttggctttgcctcctcccctcactgtgtggtgggtggagctggctcctctcaagctggtgccttcctggtgtgcttgctgctgctgtggtgcccgtggcccatctgaattaacatcttctgcggtgctttagggtgctttgcacaaagtcacttgagactgatggtgctaaggactcatgggtaatggtctagtcttaatgttctaattcaatccaatccaacttttttgttttgcatatctacaaagtgcataggaatatgcttcgtactgggaggagaactcatagtgcttaataaggactgctatggtctgaatgttggtgtgcccctacaattcccatatgggaaacttgatcttcaatgctatagtattaaaagatggagcctttaggaggggatcaggtctcgagggctccatcctcatgaataggattagtgcccttatcaaagaggccagcaggaacttgtccctcccttcgaggtgggaggcggggctggactctggagctgggctcagacaccagaccaaaatgaggactagataaaacagggaaggggcaaaagcagcttttcataagacatgcccaccagtgtgccatgtccgtttactattgtcccaacaacactcaggagttaccgcccctttccgtggcagtgaccccacgacccagaagttcctacccttgtcctagaaatttctgcataaactaccccttaatctacatgtaattaaaagtaaatataaatatgactgcaaaactgccttgagctgccactctcagcacactgcctatggggtagccctgctctgcaggaccagttatggacctgtaacactactggagctgtgacaccgcctctttaataaagctgttttctgctaccctaccaccagctcgcccttgaagttttactgggtgaagccaagaactcttgtgggctacgccccactttggggctcacatgccctgcatcaccttttgccataggaagacacgttgaaagcactatccattagtaatggcccttgccagacaccaaatctgctggcactttgatcttagacttcccagcctccagctgtgaccaataaattccattttatttgtatgttttttttgttgttgttttttcttgagacagggtctcactctgttgcccaggctggagtgcagtggcatgatcttggctcactgcaacctccgccactcaggtgcaagcgattctcctgcctcagcctcccaagtagctgggactacaggtgcacaccaccacacctggctgatttttttatttttttggtagagatggggtttcatcatgttggccaggctggtctcaaactcctgacctcaggtgatctgcccacctgggcctcccaaagtgctgggattacaggcatgagcgaccatgcccggcttgaattctgttgtttttaacttacccagtccaaggtattttgttatagcagcaggactggactaagataaggactaatcttagtaggaaggaattaacatggaccttgtgagttatggctgatgctcaaaagcctggaggacgccttgcagctctttccacatggtgtgttctggaaacactgtcttaactcctctcagtttggtctggagtttgatagtcatgtagatttgggattggcatcacaacctatagtcaaagtgatgaatcctcttgcataacacaactactttgcattttaataattttaataactttgataactaaacatttactcaaaaatgtatttcttgaacatctatggagtccagatattggggtctactaggctttggctgtccttgtgatttttaaaaccagaagcacccagaaactattaaatccttaaagcaatacaaaatattcacagccatagcatgctcagtagagaacctctaatgcctgaaacaaggagactgtttactttagcacgtcagtacttgaggatttattctgtgttgcggcttctggcctgcgagttcagaataacatgatgtggatttggaaccaaaatgaacacagcaacagacagtctatcacgataatgggaaggagctggagtctgcagctgccatcggcatcaaagatctagcttttattgagctctctatatcccgacagatccttgtcgtatggaagtgatttgcgtaggctgagaacagtggggtgaaaagaaccagggcatttctaaaaaccagtgagagcaatttacaagcctgagccaagaaacaagctggacacaccacaaaggaaatgcattttcccagtaactttttttttttggaggaggctttagagggctggcctgtgaattgcatttgtttatgaattgtctagtaatcacttgcattgtcgctggatcaggaggggctgtattttcttcccacacctgatttccatgattcagtgcacctcaagagctccatttgtgtcaccttctctgtggctgacgtgtgcgtttccactttgtactgttaatcagttaagtgaatatgagctgggaagtgtgttcaccaaacacctggctagcccgaagctctttacatttgacaaaacgggagacagaaattagaatggcttttctattttagtctagattatggaattctgtaatcaagattactttaaaaccatcatttgaatgaggaggtaaaatagccttgatacttcactgctggagaggaacaatagacaaactcaaaagacaaaaacatgaattttaaatgacagtttgtcccaaggacatcgtcatactgtgtgctttttacagtctgcttgttatcttatgcaattattgccaatgtgttttgctaatggattcattgcaagtggacttaccctacgtggaatgaggaatgtccatatgtggtagatgtgttatttattgatgaggagaggaaagtggatcaatgtggtctttagatgtgcgtgctttgccttgggaagcaccagcattgtcgtctgaactacaattggtgtgtatctgggtggaatgtggtacccgtggtgagtttgcttgttctctttccgttggcccacttgcagcaaccaactgttgcctggactcggtattttgggggccattttctcttacttttatctgttggccttgtggttccatctgtaggttgctctctccgtctagcttggaaacaacataatgattccttccgaatcactggattcacagggttgagggacttgcctgccactgacattcgttgactgggattagaatttgaaaagattttcgctgttgcctcaggtgttctgaaaggtggaatgaatcatttccactcagttttaatgctagagggagaaaggagtcatgttaattagatgggaaagatgatctaatcctttctcaaagagcctttctataaggtttagggtactgtccagccagcctgcggctgcgtgagactaatgatgggtactgggctgttgttccatttctgctaccattcattgttggtgcctttggtaaataattccatttcattgtgacttcatcttctcattgggaaaatgagactggtgatgttgcgcctcttgggttaggcgtattctgtggtaggatttagagtcaaaagtgttttttatactaaaagacactatggcacatcttcgtaggacattagcttttctttgaagatctggtggtggggggaaggggaaccattttttgaacagtaaaaaataaagagatatagtatggaaaacaatgtgaaatgtgaatgaatttttaagatagatattttaagatgaatttttaagatattttaagatgaattttaagatgaatttttaagatagatatgctgctaagtaatttcttgctagatttcaactgctttggggtgtgtcttcctatggaaatgaattcctcgtgcccacggccattacatttcctacaacggaaactttgacttttgtttttttttgaagagacattttgacttattttttattctaccgtttttctatttgctacctcatttatttctacttctagtttgttattttcttccttctgctttatgttattcttttttgtaacttttagaatttggaatttaatgctttttaaaatttttatcaatataagtatttaggccataaatgtcccactgttcagtactttaattgtattttatgtattcagatagatagtgtttttattaacatttcgttttagaaattctgcaatttgggtttgtagttctccctttacccaataattacttaatatcaaatttttaaatttctgagggtaacagcctctttgttttattacatttatttatttctggttgtcttctattatgatcagataatattgtttttattttttaatttatgaatttattgagatttgctctgagttagttaatgtatagccaatttttatgaatttcacttgagaaggtgtattctcctttgggtacaaagtataatatgtatccagaagatctatcttttttttttttttttttttttttttttggtttttgagatggagtcttgctctctcacccaggcaagtgcagtggcacaatctcagcttactgcaacctctgcctcctgggttcaaaaattctcctgcctcagcctcccgagtagctgggattacaggcacccgccatcatgaccagctaatttttgtattttttgtagagatggggtttcaccatgttggccagcctggtcttgaactcctgacctcaggtgatccacccacctcggcctcccaaagtgctgggattacaggtatgagccaccatgcctggctaagatctatctttttaaaaaaattatttactgtggcaaaatacatttaacctaagatatgcgattctaagcatttttagttgtacaattcagtggcattaattacattcacattgttgtagaactatcaccattacctgttttcaaaactttttcatccctccaaacaatctctgtaaccattaagtaataactccccactctcctcccctcaacccctggtggcctccaatccactttttgtttctgtggatttgcctactcataaaagtggaatcatacaatatttaaccttttgtgtctgatttatttcacttagcataatattttcaaggtttatccatgttgtagtgtgcatcggaattttattcctttgtatggctgaataacagcatatcattgtatgtattatatataccatacttttttatttatttatctgttcatagacacttggactgtttccatctttggctattatgtaagtaatgctgctatgaacgatggtgttcaaatatctctttgagtctctgtgttcagttcttttgggtttataactatgagtggaattgccgagtcatacaacacttgtatgtttagctttttgaggaaccgtccaactgttttccacagcggctgcccattttacccatcagcaatataccagggttccagtttcttcacattctcgacagtatttattttccttttttttaaaaaaagaaaaagttatggccattctattagatatgaggtggtatgtcatgattttgatttgcatttccctagtgactaagagatgatgttgatcatctcttcatgtgtttactggtcatttgaatatcttctttggaaaaaaaagtctattcaaatccttcgtccattatctttatattgttgagttttaggagttctttatatattctggatacaaacatttatcatatatatgatttgtaaatattttcttccattctatagtttgtctttacacttttttgataatgtcctttggtgcacaaaagcttttaattttagtgaagtccagtttatcttttcttctgttgcttgtgcttttagtgtcatatttaataatctgttgtcaaatcctaagttgcaaagatttacctgtatgttttctcctaagggttttatagttatagctctcatatttgggttctttacctattttgagttaattttttgtgtatggtgtgaggtaggggcccaacttcattcctttgcatgtagaaatctggttgtcccagaacactagatctgttttattgatcatgttatttagatcttctatagctttatttttttaaaaaatctccctgaattaccttggactaagagtggcaatttcaagcagcattattaagagccatacagaagcctgaggcaaaaggaaaaatcagtaatactgcatcctgtctttatataaaatataaaattttcacattttattcatcacaattttttgcatttatttttattttttaaagtattgcattaaaagattattgattttggttcctgagtttttgccatcaccttgaattatgtgaccaagaagagtgccttttcaccttactatagtcccagccctggggtaaaggctcctaatttgagtgtgtttctgtctatgtcttcttgcagctcatgtggttttgcatttttgaaagcggttgccatgtatctggtataaaaatattcacaagtgttttacttctgctgtaaattgtgactttttctattacagtgttatttgtcgtaatactttttggcatggattctgccttgtctgttatcaggattacaaacgataggggaaaagataagacactaacaagtcttcagtttaccaatgatgaaatcagggcccaaggactctggcaacagttgaaagaattatgatcattaagttaaaaatgtttattacttctaaatcctgatattaaagtaacagcccagcgtacttccatgtagaaatgatgtcattctgaaatggtataaataaaaattatagtcaatattctcatcatgttcaagcagggcatgggccacaaacccacctaaggacctgggaagggcgggtttcaataaccttcaggctgaatgccactcatacaaataagaagcgtggaagctgagggaaggccaatcagttgaagtagggtgattcagcccactcaatatttgaaatattggttttaatgagatcctagggctccattttagagctactagaagttttatgagtgaagaagggagctgttttactgcactatacagagtctccttatctttcccttttgtcattcttgccataaccttatagcctctaacttaatcagcctggcttccttcacgtaatacagcagcacttaacattgccttcttacttttcttctaagtagttctagtttctatgtctgagcatccagggaggtaaatgcaaagaaggatggaaataaaatatggctcagctgtggcctgagcagccccttccaaatgcactcacggcttctctgcacatcttgatatgtgaatgggaaagaaaaaaaagcacattttggtccagcaggttttcttccctttgtctccctctgaggtgctcagaggcatcagtaacagagcaggaaggccctggccaacaaaccttagccttttcctttgataccttccattgggagccttcatacaatgcatttgaaagcactttgtcagcagactcctgcttcaggcaaacattgagaaaactattgaggaggcctcaatggaaaggatctgatctgccccagaaactgccctagttctctggcaggagagccaccagcaggagaagagaagtcctctctcctaccccattttttttctttctcctttttcctctcctttctattgtaagaattgtgggaactctctttaaatgaaaataactctcaggctgagctttgtctcccaatgtggataaatgcccagatatctcatatcccctctgtaaagctggagtctcagttttggatgatcacaaactatttgggacaaatgtttgagctcaaggagaaacacatggtaggtggtgtgtgcatagctttttctaaagcacctaaaaattgaatacttgttcatcagcctactgcttgcaagccctttgctaccacttgctggtctgttgtttgcgcctctgcaggctggctctgtgtcatgtttgcattggtatccgatctctccctgcaccaccccttgctcgattttaattgaatttaatgatttctgaacccctaagcgtctatcactttttaaaatccatactacaggccgggcatggtggctcacgcccgtaatccgagcactttgggaggctgaggcgggcagatcacgaggtcaagagatcgagaccatcctggccaacatggtgaaaccccatctctactaaaaatacaaaaattagctggggatggttacacgtgcctatagtcccagctactcgggaggctgaggcaggagagtcgcttgaacccgggaggcggaggttgcagtgagtcgagatcacaccactgctctccagcctggtgacagagtgagatctgtctgaaaaaaacaaaacaaacaaacaaaaaacaacacacaaaaaaacatactgcattagtttctacctacagtttcagtataagcaaatgcttaaggtgacgatgccaagagaaataaaagctctctttagctgccttcttctcccgtcattgagaagagccttattagatacagatggatgaatattcaagaagccagagagtgtgaagaagtgagagaggctgacccttgccctgagcaatgctagactcttggttgggaagttctgttctgccagcacccctgaggccagagaggccttgctggtcttctctgcgtctccctcaggacatggctgcccagtggaggacattcagccactcagcactgggtatgatcttcccttaacctattcccgtctatcaaaatgaagagccacttctagatctaaatttctgtaattatctgataatttatgttttattctaattacaaatctggcccattaaaaaaaattgagactgtatcagggtataaagaaaaaagacacccatgattccaggagtcagggataaccattagtggctttttagtgtgttaccttctcatcttttttcatacatctgtagttattttgcagaattagattcctgtgtgtatgcaacattttcttcactaaccttatctcttgaacatttacctgtgtcatttagtataaactgaaaaataaatatccgtgaagactctagatcattacattatgtggattatattttatttaatgaataccttatcgttgtatatttaagtgttttgctgtgataaatgatgctgccatgaatatgtttgcacacaaatctttgtacacatctgcgtttatttccttagtatataattctagcagtcaaggtgttttgatatttttaaggcacttaatacacaatgccaaattctacaccagcactatatgaatgcccagtttctggaacccactccaatactgaatgcgatctttgcgtatttgatagtttaaaattatacctcactttaaaagttgtttccttttcttgctcatttggttgaatgttttcatgtgtctatcagccatttaaattatcctgctaaatttttttctgtggcttttagtcttccttccattaggatatttgggtttttcttagtgatttttaagaactctaggattctattattttaaaatataaattgagttaccaaaatagtttaaattttaacaaaactgctgtagctggcctccttttataaggtaaccttgttattgtttgccagctgttgtgcctggcacagagctatgcatacccaaggggctacataaatgctttttcattttttatttttatttttatttatttgtttacttatttattgagacagaatctccctctgttgcccagtctggagtgcagtggcatgatcttggctcactgcaacctttgtctcctgggttcaagcgattctcctgcctcagcctcctgtgtagctgggaccacagctgcatgctaccatgcccagctaatttttgtatttttagtagagatggggtttcaccacgttggccaggctgggctcgaactcctgacgtcaggtgatctgcccgcctcggcctcccaaagtgctgggattacaggcatgagccactgcacccagcccataaatgcttttttaatgagagaatgacctattatctaaacataattgatgtacagtgttggttagcagagctagtaggagaatttttagtccattaggagttataagaaaagcttttagaatgaattgtcccagaaaggagagctggaagaaaaaaacccaaaacaatattccacatccacatatatgacctaatgttagcggaacatcacagaggacaaatatcgcaaatcagaacaaaaggacagctcagaggtatttttcaaattgaacaaaattgtatgcatgcaaaatataaatagaatgatattagaaagattttatcaaatcttaatgtttcggcacttttttcctgctgtttttaaagaaataaaacatgacagaacagttgacacctctgcatttctccttttatctcatccccctttcatctataacacaggtggctttgattttgaatatggtgcttatcatctgagtgtgtgctttcatgctttgatgacataagtgtacaaatggtatcatactttgtttcctattgcaacatttcttttctcattcaatattatatatttgagattgatccattttaatagtattacatcataggagatttcacaacttatttattcactctctcatgtatggtcattccagtattttgctcttgcaaatgttgctacaacgagcattgttgatcatgctcccttttgcacacagataagtttctctagggtggaaatggaattgattgctaagtcataggtatggatctccttcttttctagaaagagccaaatcatttttcaagtttttaaggtattatataaatacctgcatttcccccaaggacattttacgtaaatgatgccagttaatatttgtgagtgcttcctatgggccaggaactgtcctaagggttttatatgattccacacatttgatcctcaactattcatttgacaagtgaggaaactgagattcagagaacttgaggatcttggccaaggtcttatagcaagtgccggagcccactcaaacccctcggcagtgtcgttctcaagccctctctcttaaccccaggctgtgctctaggtgctagaaagacactacccatgccagtttatagggatataaaggcagcggctatttaggctgtaagaaaactccaacaaaccgaagcagccttcctagagcattgctgttgtacagataggaagaagaaccagatggttgctcaatgtgtccaaggtccgcccgtcagtgactgatccaagactaaattccaggctctagacgcacatggcagccaggttctttgctccctggctctcgctgtctcactctcccttgctccctccttccctgtgtattcctgaaggcatatagctacatcttcatgtgcttttaatttcttttagcctagagtagacgctcataatagaaaggtcaaataaaattttttaggagtagtaatggatgtaatcttgtacatgtacatgttaattgcagcactttaatccccattctaagtaccaaactttccggattaatttcctgcatctgttggtaacacgggactcagtcttctgaccagattctttgcccaagggccctcatttactaatgagtaatcactgcaatttcagagaaaatgctactggtacactcatgtttgaacattcatcaaatatgacgtgagcccagttaggagagatgttagcgtccttagcctacaaataagggcatagaattaaatctccccacgctataattttgttggggttattacttgcatcaatgtttggaacagttggtgataaaacgtttcatggtcttacagctcagtagataggagcatgtcatgagtcaggcttaccaaaggacttactgcagacttacttccccttgcctcctgtgattcaagccaattttgcaaagagaagacagaggtggaagaggaagtcccttcagcaggaatgcatttctctttgtgcacatatcacagacacacagcactgacacactaattatagctttaggttgagcatttccagtttctgcattttgtttgcaaacagcccattatttctatcctgtgtgctggaaaaacacaaaatgaagcagtctaatcactactgtttctggtaggtccagctgtctacctgtctcccctcttttggttttatttttttcagggtgggcctgtaactcctcttctatccccacccgattttgttttttggaatctttctaacctgcctgcagaccaggggttgcagttccagctttccatgatcttacctgtgttcagccttatctattttgtattgaaagaaacagtcaacacagtcaaatcctttataccttccttaagactgcactggtgtggcctacatagccacctgtgtgccagctgctgtttgtcactaggaagacagggtgggatgtgcgggtggtatgaccgaggtgtgaagaatctcagggttggctgtgtcagtgaaggagtgaacgggcactttggggtcacctgaactgggagaactaagttctcaagcagcaaaaacagaggcacaaaagtggataaaaacccaatagtgcagacctggagctaggcttcttctctcagtggtggcacagaaaaggatgaaagtctctgaaatgtgcacctgtgattcaggttgccacccactgaaaaatcatgattcaagatctctcctcctcataaaccttttttttttttccctgcctgcagcctaagatagaattaggaagtcaagaaaggctctagatgactttcagagtgttttttgtttgtttgttttttctttttgagacagtctcgctctatcatctaggctggagtgcagtggcatggtatcgtctcactacaacctctgtctcccaggttcaagtgattctcctgcctcagcctcctagcagctgagattacaagtgcctggctaatttttgtatttttaatagagacagggtttcaccatgttggtcgggctgtctcaaactcctgacctcaggtgatctgcccacctcggcctcccaaagtgctgggattacaggcgtgagccaccacgcctggcccagaggtttgttttttttgttttgtttttgtttttgtttttccagaattagcacatcttctcttctctgggtcatttttctcttaaatcagagattgcaaaatgtggtccaagggtcaaatccagcctggagtcccctgttttggtaatgtttccttgtaacacagccacccccattttttacaggctgtctgtggctgcttttgtgatacgatgcaggagttgagaagttggacagagaccatatagtttaaaatatttaccaccctagcctttgcagaaagttcgcccaccccttagagtacagaaaaagaaagatttcagagatgtcagtttgggaaggtccttgaaaagtcacttggcaaagaaaagttgtgagaagaaggttgatgttttgtcaaagaaatgcaacgatgacagatgccaacctgccttttcttccagcggcagaggacctcaggccgtggtgtgcatgcccgtgtatcggtgtgggtatgtgcacctgcacacatgtgtgcttacacgcagctcaaaacggtgccaccctgtccagagttattttggccatcatggttcaaatcaacagacttttctggaaagcttctgcacacatgccatgctcagaacaggaggtgcaaagatgggaaaggattctgcctgatatgcaaatagtgaccgaaaacaaatagtaaggagtgaggctgatggagagctaggggaaacaactcactgtccctgggagggctgcagaggacccagcacaggcgttctggggtgtaatcttccttccattctcgtgagagaagctgagtggaaaccaagagcctggcttttcagtgaggacatgaagcctctgatagttgccttccctctggaggtgaagcagtcctggaagaaaacatattcttacctcaaattccaaaacaacatgtggggactctgttgagaagcctgggtgacctagggctgacgtggtagaatccagactgattctgcttctgctttctcttaaagtcagctcagttttcccaatttttatctttttttttttcagggtctctctctgtcaccccagcaagagtgcagggctcactgcagccttgacctcccaggcccaagcaatgcccccacctcagcctcccaggtagctaggattacgattgcaccccaccatggttttcccaatcttataactaattagatccgctcatcacgtgtcctgcaagcatgcagtggcatgtcacagtgcccatctgacagcagggcagggtcgtttgttgagagaaacccactgaggaggaaataaattaatgtccatcctttgctcccatcacctccagctgcaccatccttcaccaggacccatcagagcttccccggggatgctgccctgtggttctcggggaagctgagagctctatgttgcatcttccagggcacctgtggtctccgaagtgttggctgcaagaatggctaagcagcgcactctcttcagacaagaatagtattttaattgccgacagaatgcagatatcgtttccactattgcctctgacacttaattttaggccgggcatggtgactcatgccagtaatcccagcctttagagaggctgagcctggaggactgcctgaggctagaagtttgagaccagccctggcaacatggtgagaccctgtctttaccaaaaaaagaagaaggagaaggagaaattaaaattagccaggcatggtggtgcatgcctgtagtcccaggtactcaggaggctgaggcaggaggccaggagtttgaggttacaagtgagctatgattgtaccactgcactccagccttggcaatggagagagaccctgtctcagaaaaagaaaaaaaattaaaaaatgaaaaaaagaagaagaaatgtaagtttaggcatcttgaaggcaggagattttgactggtaatggtggaaggattttgcaaaactccatgagttgacctcattcctcagaaattccattgagaatggagggtgttatgtgaaaatccgaatcacaggggatggcttcgagacatgtggaaagaatgccgccattacatatgcacgcgtagtgtttgccccagaggaggcttttgaaaagttcatctacaatgtgctaaagtcgagttttgcagtgacttcctagcgcatttagactgggcatagtttacattactgagtatttatcagccagcaaatcaaagccagaaataggttactcctttgtggagcaggagacagtgactgtcctgggaggaagtgactgtcacagcaatggattcctttagtagcatcttcactgtgtattcaccgggtacccaccgtgttagcgatgacagccaccctgtatcaggtactcccaagtgtccgttcccctgttactgagcactttacaggcactcttgttttgtgctcacagtaaccattgagggagatgaggcacagaatatgaagttagttgccaaaagttgccagagctgggatttgggctccaggtggactgactttagaggctgtgccctccatccttgccctgaacaacctcctgtgaagaaatcagtgtgaatgaatgaatgaatgaatgaatgaatgaatgaataagacctgaagaggcaggcaggctctgggagatgcagagacaacttctgcccagtttgtgctcaggttgtggagacaaggcttcctacgagatgcacacacagaaatttggcagaatgggtaagtggatagcacacagtatgaggtgggtccaatgactgctgagattccctctgtcctccacccacactttctcaacggtgtccttctcagaagagaacctgcttcttcgaccggcctggtaggaacagcactcaccacccatttgtgtgccagtacaggtaagtaagagtgctcccggccgcccttcagccgtggtgctcaatctgctgcatgcatcaccttagccaatcctcacgtcaatcccactaggtagggattatcactgcagttatatagacaagggacctgtggctcagggaggttaagctacttgccagatctcatggctaagaagtggcagaaccaggattcatgcaatggtgtggccgtccttcaaatcctgtgaacctcccatgggaacctcccatgacatcttgtgtctcccctggatatacatccgtaccatgacgggttttcttttttcctggtgggaaagggcagctgggggtgagaatgctccagagagtggcagaatggagctatggacatgaaagtatttggatcgttgggaagtgcagaggtcagctccgcacacacttcctgggactttgcagtcaatggttactgaagttacttaatacccacttgtcccacgactggtgagtcccgcctattgcctgctgtcctgtggtgcagctgctgtttgtccatctccagggccaccaaagcccgtctggattgtgattcaaggtgtaagaggacatggaaaaagaactgatttgtgttgtatgagtttagtttaacttgattacaggaaactgttggtgggtgaatgtaggatttcattgcgtataaacatttcagagacaagtccctttcagctactttctacttgggaatacttgtgaggtttttcacctaaggcttccccgtaatgattttgtcctgatgattcattccttaattagtggtattttattgccgctttgccacagagctttcaaaaccatcacctcctcctcctcctctggaaaacgtgcacagactttgcccacatttaatcatgccatccccaccctttctagtctttcttcaaacttctaccagttcctgtgtttctgagaggagcccaagtcaaacactatgagataaacatcaagagcttaaaatgaatgcatgttcaaaaaatatgctggtctctgattccaaacatggctactgctaacccattgaagacccatcaaagacctgactattctgaattgttttaatagcagtgaggggtgagtcgatgtctcaggagaggatggcccagacctaggtaatgtgtgtcccgtcccccgacccagtgagcacgtgtgtgcatctgtgggtgtgtgcgtgtgtgggtgtgtgtaggtgtgtgtgtgtgggtgtgtgcgtatgtgggggtgtgtgtgggtgtgtgcatgtctgggtgtgtgggtgtgtatgtgtgcgtgcgcgtgtgggggtgtgtgcccgtgggtgtgtgtgggcgtgtgcatgtgtggatgtgtggcaccatgtgtgtgggtgtgcgtgggtgtgttcctgtgtgggtgtgtgggtgtgtgtgcacgtgtgtgggtgtgtgctgtgcgtgtgggtgtgtgggtgtgtgcatgtttggcaccgtgtgtgtgggtgtgcgtgtgtgtgtgtgggtgtgtgcatgtgtgagtatgtgcatgtgtgtgcaagcgtctggcacacggtgtttttgactggactgaggttgtggtaccagagtccagaagacagacagttgaagttgtgtcgtggagggacactgacatgaaatctggcaagtcatgtccaaaccaggtcactaatcaattgtgagcagagagcagtgagcagagggcagcagctatgtgcagagccagaggccggggttcgaatgcacaggagccacgtggacactgctgcaggctgcccgggcacccagccgcagattacctgtgttacctcatgcctttttttttttttttgagactgagtctcactctgtcgcccaggctggagtgcaggggcgcgatctcggctcactgcaagctccgcctcccgggttcacgccattctcctgcctcagcctcccgagcagctgggactacaggcgcccgccaccacacccggctaattttttgtatttttagtagagacggggtttccccatgttggccaggatggtctccatctcctgacctcgtgatccgcccgcctcggcctcccaaagtgctgggatcacaggcgtgagccaccgcgcccggacccattgcctcatttcttcctccagccgcctgtgggtggggactgttcccgctgcagtctcctgggtgagagatgagggagctgctggtgagaggcggttgccccatcacctaagctcgtgaccaggggagggggaaaagcatcactgctcaggcaggagcccccatgcctcctgcttggggttcacttaaaggcacggcttagagagattctatcgaccaaaggatggaaagagccacggagaaagtatctttccggtttttgctttcctctgtgttccgtttccttcccatttacacaggtgcctttagcacgtagatattcacagctctctagagtcaccaactcctcgaatatccctggggtcctggcagaaagcggatggcgcgctgcgtctaacggagagtttttggaaaggactgtttacaaaagctgtcgcaggtgcaggcaagccgtggtgcgcagtgctcctgccagccgctggggaggcctgagggcaggaggggaagccacgaccaccaccccgagagggaggacccgggagcatcagctgagaggcatcatgggacaggagccaggaggacaagtgccctgtcctctcccatctccttctgcgctctccaagggctgagcccatcctgaagccagaaggaagcctgtcgaggcagcttgcatccgtctgcctcctggcgcagagcagagtagagagattgaagagtggacctggacgggcaagtgttcatagaaggcgcacagtacgagcatctcatgaaaacagtgggccctgctgctcagaaaaatgcccaaacacaccaaatgtggcatatgttttcaggggatccatataccccttttagccagtctctggaccagactgtagagtaagagtctgatttagatcgatgggaatgtttgtttgtttgtttgtttgtttgtttccctcctgataaaaaatcctggggtttgtgctctcctttaagtctgtaacagctgagtgaacaaatggcctgcacgccggctcccaggtcagatgtccagcaagcagacgcttcttttcttgtttctctgtctcaagggagcaagtaagtccagaagaagaaaggatctggtgaaggaggctgcaacccgaagttattttaagagagtgttgaaaatgagggctatctaaagcagaatgtgtggctgggatttacaaggtaaatcaaagcagctgtaggaaggaaagaaaagattttcaatgacaaacgttttcctttttacttgttcttttgaaagaaaggggaatgtgtgggcagacagttgtgaggatcttgacttaaatacttgactgccttttcacatgcatgctttaaaaactctctggttccggctgggcgtggtggctcacgcctgtaatcccagcactttaggaggccaaagcaggtggatcacttcaggtcaggagttcgagaccagcctggccaacatggtgaaaccctgtctccactaaaaatacaaaaattagcagggcgtggtggtgagtgcctgtaatcccagctacttgggaggctgcggcacgagaattgcttgaacccaggggacagaggttgccgtgagctgagatggcgccaccgcactccagcctgggcaacagactccatctcaaaaagaaagacaaaccaacaaaaagaaaaacacaaaaactttctggtttcttaaatgaatgacactcacttcgagaagaaggcccgtctaacctcagccttatttttgcattcagctagataataaagtcactcaaggtcttgggtccaaccagatgctaaaaatggctgtttttgctcaacactataagattggaagtcagggagctttggactttggacatttggaactgaggattcacctagaacatcaacgtttttgaacattccataataaaataaatcctgttaactcttaggcatttatacccccaatgtggtgggataaaaggatgaggaaaaaagtggcaccaagatgatgcgagctctttattctgtgtttcggtctcatcccattcagatgcttcttcatggaacatttccaggcagtggtgcctgatattcttcatttcttgaaaattctggttttgttgccctgagagtttgagatgaaaatctggttcctggagaaaagggtcttcttctatcagtgaagcccgtcagtgtttggttctggagtgactgcaaacaaaaagagccctccaagtctcagctcttcccctctctgctggtagatggaaatctctggatctgaattcctaatgggccccaccagtctgatattttaattagtctggtttaaacatggttggaggccgggcgcggtggctcatgcctgtaatctcagcactttgggaggctgaggtgggcggatcacttgaggtcaggagtttgagaccagcctggccaacatggtgaaaccccatctctactaaaaatacaaaaattagttggccatggcggtgtgtgcctgtaatcccagctactagggaggctgaggcaggagaatcacttgaacccaggaggtggaggttgcagtgagctgagatcttgccactgcattccagcctgggcaacagagtcataaaaaaaaaaagtgggggttggggggttggcagtggccttcacacacagcagtctctgcctttaataatggtttaaatcatgtgttagatctaggccctttggtgagagccaggttgaacacccctgaagcatttgctctttgatctatggcctcctattcctttgaactttcccagaaagcagggtgggggtggggatggggaacactaacccagaattctttaaatttctttctaatgatttggaatgatcagaaacttttaaaccaacttcatttccaccttccagccatgcttatccatcgtaagactatttttatcttccataagaacccattctccagtgactcttagatggaaaacacaacactacagagttaccataaaccacttttccttaattgctgacatggaaccagacagaggggggtcattggtttggagaaggagagggagggagaatatctacgccctctctgtccccttcccagacacctcattgcctctgaggattctcttcccttcactctcatcacaaaagaggtaattaccttatttcaggcatcctttttatagagcaggcagcagcctgtcacggtagtagcatttcactcttccaagaatggaaccattgcacaatgtcccaggagtcatttgtgatttttatgagaacctgaagaggttaaagaaaagaacagaaaaataagaaagcctttgctgagaagaagggagctgttagccaaaagagggaatttgggctgagaaattattgtctgaaatacttacatcttagagagagagagagagagagagaggtgagggaggggctttgttattgaattgagtgacatttctctttattataaagttataacgtccggcagtagaactgccagtaaaactcgatctggagtgttttctttccccctcgctatgctcttttagcagtttgcatctggactgttaaattaagggttcttgcatgggaaatacttcttattccttcagcaagtgaaactacttgctaaagtaattatttttaaatgcaaatatatatacacacataccttgtgtgtatgtatttttaaatatttacacacaatatatattcatgtatatgtatgtatgttgtatttttgtggttttgtgttttaacatcagctgcggtagaaagagaagggtggctctgctaagagtccctcctcaactggcctctggctgcaacgtaaatgacctcccttgttccctaccagcatggctggagcaaaaacgccagagtctcacgtacaaacattacctggagtcttcctactgcactcctgcactgtggcatccagagaaacagcgtcacttggggagaatgtcatgcactcctgcactgtggcatccagagaaacagcgtcactcaggggagaatgtcaggcagggatgagctgccttgacttgaaatggtcttgcctctcatctcaattaaaatcaagccattaactggctttaatgtagagattttgtggttcagttttcttcagtggtatccattataaaaaaagatgggggttataggtagcagaactgattggcatagttgtcaggcatatagtatgtattattaatatttaatatgtattattaatgttccctacctatagtgagagctatcctggcttaatcagttatccttcactccaggacgaaaccatgctttctgtggttacctgaattccaggtggggctaagcacagctaagagtatctggtagcctcttcaagtggcttttgtatcacccaaaccttttaaaaactgccacacaaactgataaaaacgtatacttctgtctatccttgattgaatgtaattgtcactatttattttaaagaaatggacaacttagagccctattgcaacacatcccaaacccagctcacttaaaccattaatcaaaacatttttcctccctacctgtggtctgtaaggaggatacaatctagtctctgattgcacaattaaacaggtgcagaaagcagtctatggattcatgccaaatgagtggtactggaagggaattctatgggagttcaaagaaaccggaggtcacagtagatcagagttggttggcgggagtctcgggggagaaatggggtttgacgtaggccttgaaagaaccgataggattcagacaaacctgagtaatgggagggtgttccgagccacacacactgattgttcagtttggtttgctcagctagaggacgtgttgggaagatgggtctgattggaggtgacgttgacacccagacttagattctaagggcagggggagttccctgaaggattttaagtgccaggggcctggtagtgctcgtgtgttaggcagaagggaggcgaactaggctgtcacaatcatctagattggagttactgagaatctggatcgggtggacatgaaaagaaagcagtggattcaagttacaaaggaagaattggcaaggggtggcaaaacagtcactgcttggaaaaaccatttttctgaagcataatgccactttgtttttgtttttgtttttgagatggagtctcactctgtcgcccaggctggagtgcagtggtgcgatctcggctcactgcaagctccgcctcccgggttcacgccattctcctgcctcagcctcccgagtagctgggaccacaggcacccgccaccacgcccggctaattttttgtatttttagtagagacagggtttcaccgagttagccaggatggtctccatctcctgaccttgtgatctgcccgcctcggcctcccaaagtgctgggattacaggcgtgagccaccacgcccggccaccactttgacccctgtctttgctctgtgtctcctgaaggacaagaaggccatcgtgctaggcttcggaattccctgcctattcgtgcataatttgaaatcatctctatgtagctttcagatgctcatttccttctggactccctagtacaatttcatcaatttcatattctctctctctctcctctcataggtatatagtatatattttacttgatgactgactcaagaattttcagatgggttctgatcttgtttagctggaagcattttctagagagccaaagccattgttattttggcttctacatttattgtcgtatattcaagcagaacagtgtaaaaatgattaccaaagttgagcctattatttagattttgatagtatgtgtgtgtgtgtgtgtatatatatatatatttgagaaggagttttgccctgtcacctagactggagtacagtggcaccatctcggctcactgcaacctccacctcccaggttcgtgcagttctcctgccttggcctcccgagtagctgggattacaggcatgcaccaccacgcccagctaatttttattgtatttatagtagagacggggtttcatcatgtcggccaggctggtcttgaactcctgacctcaggtgatccacccacctcggcctcccaaagtgctgggattacaggtgtgagctaccacacctggcctgatagttatgtttttaactctagatgactaaaagacacctataaagatatagaagttaagacaaaagtcacaattatgttgacaactgctgttacagtgttttcaatatatttatccaatagaaaagttttattttactgcacaataatatgttctattaaattaataaaaacgtactcatgagtgacttcttgtcatacagatctctatatctcttagagctgtatgtcggcgttttctctctggatatataatatacatattaatcaattcattcattgagcctgtgcttggcatgattccaggtgcttcagtataatagagcaataaagacaagccccctgctctcttagatcttacttttttttttttttgaaatggaattttgctcttgtctcccaggctggagtgcaatggcacgatctcggctcactgcaacctccacctcccgggttcaagtgattctcctgcctcagcctcccgagtagctgagattacaggcgcccgccaccacacccagctagtttttgtatttttagtagagatggggtttcaccatgttggccaggctggtctcaagctcctgacctcagatgatccgcccacctcggcttctcaaagtgctgggattacaggcgtgagccactgcgcccagtcagatcttacattctgatagagggatatagacaataaacaagccagaaaatacctgccagtcaaaaagctgtgatgggaaccagccaggcaaagatctagagggagagcaccaggcctgtctccacttatgtgagacgtacagaaacacacagcgccttgcccgtgggaggttctcaccacgtatttattgaggaataaatgagtgaatggatgtattcattggcctgcttgtaaaaccttcaccagtggactcttggcttttagaactttattacaggttgagtaatatctgaaatatcccttattcagaacacttgaaaccagaggtgtcttggattttgaattttggggggtttggaaatatttctactgtacttatatttatcaagtgagcaccctaaaatgaaaatctgaagtcctgaatgctgcagtgagcattctctttgagcatcatgctggtgcttaaaaagttttggattctggagcattttgggttagggatcttcaaccggtatgctaacaatagtgatcttatgtagtattttccctccaaagagatttgagagagaaataagtggctgccgtggttggccgtctttctctggctcacttcaccttgttgccctcggataactccagtgaactccttcttacttttcaaggccatggctcttccaagcaacctccctgagccccttgggctgggtcaggagggttccccaggcctgcatggacctacaatgtgctactgaaatgatcatttatgtgtctgtctctttctctaaacagtgggctcccccagactgggcacaaagttatttacctaatgtagccaagaggtaggtgtgcaagaattgttttctgttgagatgaaaatcaccaagcctggtcatttgctttctgtgtagacagcagtgtgttgttcacttaggactctgctctctgtctcgtgcaacttaccctttatttagggaaaatgaacaatctgtaaacaataagagaacactggcaaatcaatacagtcaagacctgtgggaaaatgtagaggtgtcaagagtaagagaataagctgagggagcaggtgtggatcaccatggtctcctttgacttgctcaataaagaccctctgaccaaaggttagctgcaaacgcctttgttttggagggctagtatgcagtggtttcgtgatgtgtcttttatatggtctcatggttttcaatttcttaattgatgtttctgatttacctgaaagctttaaatgttcatgatcttggcttggtacacattagacattaaggtttacaaccgatgcctgtcattgccatttgaatgtgttggtgacattcctggtgtggcaagctaggcgagtgtgcccccatcgacaaaagaggctgaattctatattctgcactatatggactgcctttctctttcactcacttgctttttaaatgacacaattcatcccattcttaatgggggttgggggagaaaggaagaaggaaacgaaagcaagcaaaagaaccactcagtgcccgcaactgttattatgatcttggtatatagctctaaatactttcaaaaatatacttgaaatactttcataggttttacaacaaataggattatacaaccaattttatcacagtgaatttccaagtcaataactgcttttcagactatgttccaaggaggggccggggttgcccagctcaagagaacaggaatccctgcaaagggccaggggcccgtcagtggctcctcctcagtgcagctctgctctctcggtttttttattgatacataatagaggtacatattttgggggtgcatgtgataatttaatacgttcatatcattgtaaagatccaattggtgtcattgggatacccattaccttaaatatttcccctttctttatgctagaaacatttgagttcttctgttctagctattttgaaatatacaatagattattgtaaactgtagtcacctactgatctgtcaaacagtaggtccttttttttttttttttgagatggagtctcgccctgtcacccagtctggagtgcagtggcatgatctcagctcactgcaacctctgcctcccgggttcaagtcattctcctgcctcagcctcccgagtggctgggactacaggtgcccgccaccacatctggctaattttttgtatttttagtagagatggggtttcaccacattagccaagatggtcttgatctcctgacctcgtgatccacctgcctcagcctcccaaagtgctgggattacaggcgtgagccactgctcctggcttttttttgttgttgtttttttttttttggagtctcactctgtcgcctgggctggagtgcaatggtgcgatcttggctcactgcaacctccacctccctggttccagtgattctcctgcctcagcctcccgagtagctggaattacaggcatgcgccatcatgcctggcttattttttgcatttttagtagagatggggtttcaccatgttggccaggctggtcttgaactcctgacttcaggtgatccgcctgccttggcctcccaaagtgctgggattacagacgtgagccaccgcacgcagcctcaaacactgggtcttatttcttctagcacactgtatacttgtacccactaaacaacttctcttcgtctcccatccccgctgcccatcccagcctctggtaaccacccatctactctctgtcttcaccaactccacttgtttagttcccaaatatgagtgagaacgtgtgatatttgtctttctgtgcctggttcatttcacttcccataatgacctctagttccatgcatgttgtacagctcttctctcattggaatatattttgtaaaacaaacaaaaaaaaattgggggtatgaaaggttttcactgctcatataaatgacaacttgtaaactactgtgaatagcaatattttcattgagtagagtgctaccaatatgcccattcagaatgaaaaactctgacaaacagctctgtccgtatatccttatcactcactgacaatcttttgattggcactggagcacccatctgctgggttttgtggagactgtggccatctctgccttttagactgagctgctcagacagttgacccaacaccggctgcctccttgccactgaatcggaatgaggtcatacttgtacatgcttcttggaaggttttcaggcctcagctctactgagcgaagacttggttgagtaacaagtgaggaggaaactgtagggttccattgtttacaatggggacagcctgcggcaccactagacattctgaggcgggtcctggttgggggtcagaaggtcattggataggcgggaaaaaaaatcattgcaaggttatgattgcaccagtgcattccagcctgggcgacagagccagactccatctcttacaaataaatcagaggaatgggagaaaatatttacaaatcatgcatttgatatttctccaatcatataccggtggccaataagcacacgaaaagatgcttaacatcattagtcattaggaaaatgcaaataaaaaccacaatgagatgccacttcaaaccgtctgggatgactataatcaaaaagacagatcgtgcattgggggcattttgagcattggtgaggatgtggagaagctggaacagtctatacgttgtttgtgggaatgtaaaacagggcagccgctgtggcacagtctggctgttcctcaaaagcttaaacacagagttaccaaatgatctaacaattccattcttagggatatacccaagagaactgaaaacatacatccacacaaacattagtacacgaatgttcatggcagcgttagtcaaaatagccaaaatggaggaagtaacccaaaggtctatccctgatgcatgaataaacaatgtggtgtatttgcacaatggaaagttattcgccacaaaaaggaataaagtgctgatgcatgctgccatgtggatggaccttgtaaacgttctggtagctgaaataagccagatacaaaaggccacatatagtaaactgcgtttatatgaaatgtccaaaataggcaaaactatagagacagaaaatacatttgtggttgcctagaactgggggtgttgagtgagacgaggagtgagtgttaaagggtgtgagtgaggaagatattccgtgttccatgatgattacatcattacatgcatagtgattgcacaactctgtgaatatatgaaaaatcacttagctgtatacttatggtgagctttatgttatgtgaattttatctcaatattaattttaaaatccaatgaagggcaaatttatattgtttttggcttttaagaaactgtcttaaaagacacatttatttatttatttatttatttatttatttacttacttacttacttacttacttgagacagggtcttgctctgtcacccaggctgaagtgcagtggcgtgaccttggctcactgcagccttgacctcccgggctcaagtgatgctcacacctcagcctcccgagtagttgagaccacagacacatgccatcatgcccagcgattttttgtagacatggggtttcaccatgttgcccaggctggtctgaactcttgggctcaagtgatccgcctgccttagcctcccaaagtgctgggattacagacgagagccaccgcacctggccaccccttttatactttgttaatggagaagtaaataaacagccagggtgtaaacaatacatgcacccccatagttcaaagggacaatggagcatatgtgttgatgtgtctgagaaaaacagaaaaaatgcttgtccctggaatgatggaaagaattgttacaccttgagaggagaggtcaagggtggaagtctgaaacaggtgtgggagatgatatttctaagagtgagccagtacgtttctggcaaaataaagactttagcaggctactagtttgtaaaaattaaactgcaaaactggagctggtttcacccttattttttaattatgtgggattagtcatttgtgcttgatgctccctcttagctcagccccatttctcttttctaaataaaaaacacttggttctaaatcctggcttagaaagcatatttttgaagctcaagacagaaaattcatttgtttgtgcattcagcaaatacttttcaagcatgcactgtgtgccgggcactgtcccaggcacctgagacacactggggaaccaagacgaagattcctgccttcaggcagcttagatcctggtgggggtgggggataggaaggggcagagacagatcatccaccacaaacacagtaggttagtcaatcctgtggcagattggaaggtgataaatgctatggagaaaaaagaacaaggtagcgcaggtacggaagtggaatggtgcaggtggcatgagtagccagggtccataacatggtgagatttgggcagaggcatagaggaagtgggggagctgaaccaagcaggtgtctggatatctctgagggaaaagcattcccagcagagggaacagcaaggttaaaggtttgaagggagagcgggcctgtcatgttcaaggaacagcaaggagtccaggttggctggaaaagagaccgaatggtagcagagcaagtcggggaagtctcaggagggtcagagtctatagggcctaggaggccattgtaagtacttggcctttttaacaatttaaatgtaattcatataccataatatttgcccctttgaggcatataatttactggtttttagtctagtcatcatactgtgcaagcagaacattttcttcaccccaaaaataaactttataccataaacacacacccacacacgtccctcttccagccgctggcacccactcatcaacattctggctctacggacttgcctattctggacatttcatattaatggaatcatacaatacgtgaacttctgtgtctgctttctttcacgtcacataatggtttcaaagtccatccatgttgtaacaaacattattagcacctattcctttctgtgtctgactagtattccatggtatggatagaccagtttttggtgatgcattcatcagtggatggacatctgggttttcccacgtttggctgttgtgagtgatgctgtgatgaacgttcatatccacgtttctgtgggggtgtgtttttctttcttgggtgtctgccgaggagtggaaggacttgagcattgcttttctcctgtgtgaaatgggaaccatcgcagtgttttcaccaggatctgactcgcatttttttttttttttgagacggagtcttgctctgtcgcccaggctggagtgcggtggcgcgatctcggctcactgcaagctccgcctcccgggttcacgccattctcctgcctcagcctcccgagtagctgggactacaccacgtctggctaattttttatatttgtagtacagatggggtttcaccgtgttagccaggatggtctcgatctcctgacttgtggtccacccgtatcggcctcccaaagtgctgggatgacaggcgtgagccaccgcgcccggccctgacttgcattttaaaagggtcgctttggctgcctgttgggtatcgactgtgggtgaacagtgagtagcaggaaggaaaccaggcaggatgtgatggcagcgacgtgggtgagagtggtgatggatcagaccagggtgggagcagtgaaggggttgacagattctggatgtattttgaagatagccaataaaattcttgattactgtgagagaaagtaaggttgtgagaatcagcccgaggattttggcataacctgttggaaagatggagctgccattaaatgagatggggaggggtcctgagggatcaggagcgcagctgaatgcaccgaggtggagatgcctactagacatcaagaggagacgtccagcagagggctggatggatgagtctggaattcaggaagcagcctgggctgcagatataaatttgggaatcattggcatctagatggcatttagaaccctgtaactgagtaagatcactaaggctcccatttattcaaaggacaaaacaacataaatgttgacagagagtaataatcttttctatttattgagttccaacagtgagctcctgttatcactaaaaacagacatcgcagataagcttctccagaaatacatatttcaacctggttgagctataggcacccagggtatatctacagaagccaggtattaatatcttagaggcatatgcatcaatatcgtgtgaagtcttttttgttagctcttttctgattatgctttcagagtttttttgttgttgttgttatatttttgttctcccatgtataccttggtttgtgatcagtgtgtaaaggaggaggaatggttgtttggttgagacatttgcaaatagtaagcagtcaccttacctaacttggctaatttgcattgtttccatacagagaatgtagtttgacagtcaaggatgatagaaagtcagaggatgatagaaaacaatcctttcttcatacagattaagaagaagaaatgaataatctaaagaaagaaataacaacaagagacagatgggatgctgactggtccagaaaccgtcaggtagcaacagttgcaaatctgagggagttcagcctggagaagaccaaggggagagagtagaaaggatactcaaatatttgaaaggacacaggcttcttttctgttgctctatatagaactaggattcgtggataaggattgcaaatagacaaatttccacttaaataagaaaaaactttcaaataattaaagctgcccggccaggtgcagtggctcacacttataatcccaacactttgggaggctgaggcaggtggatcgcttgagcccaggagtttaggaccagcctgggcaacatggcgtgaccctgtctctccaaacaaacaaacaaacaacaaacaaaaaactagcctagtgtggtagcatgcacctgtagtccgagctacttgggaggctgatgagggaggatcacttgagcctgggaagtcagggctgcagtgagccatgaccgtgccactgcactccagcctgagcaacaaagaccctgtctcgggggggaggaaagaaaaaaaactgccgaactacatgcagggtgggattgggcatggtacctgggccagcctgttggcataacatgtggaagcgggtgacccacagtcaggggtcagtctgagggactgccatactgggctagggcctctgagtgctctgccagcttaggggttccatgattctcagcagatttccagcaggtgtttgagggtttctgcattcagtgacataaacaggccctcgtgcttctgtgggttataggccagcttggtaccgtataaccagtacatcaagagttgaagtgttgcactaatgctttccaagagtcagagctggcagagtgaccgggtatacaggcagagtttgtactctttccttttagaaacacactctgctgtctgtacctgaattgttctcactctgtggaggacttgggattcttgatgttatttatcttatgtgttccaagtgctaagtagtttaatcctaatacttttaaaatgttaaaaaaaaaaaaaaaagagagagagaaatgtttaaagtttggatagaaacccttagaatcattaaatattctcagtgaaagggaccacagaggtcatctgggcccatttcctcattttatagaaaaggagtctgcaagatccagacagcagttcacccagattagttggttgattcaaactttcccttcctatttctctctacagtgttttatctacaattatattatatttaagatttggcaacaatgaccatatgagaagtccttgtaatatgccaggcactgtgctggccgtgcgttgtgcgtgcattttcctatttaaaatgccacctataagtgccatctttggaatatttgtcctttagaaagaagcatctgcttcaaaccaatggcagagacaaaatggcttttctcttatctttactactgtgtggatttctccataaacaagaactggcaaagggcctcataacagctctgtggccctctctgggctcagagaatgcccgtagccaccagcccagctggcaacaaatggttgcaggttctgtttccatgtttcagtcaatctgtctagagaacaatggaactcctgaaccattcccgtgctcaaatgtaacgtaaaaaggacaatataaaatatcaggcttctgtgtttgaactgctcccctggggaaaggagcatggtggttgggaactcagcattaaacaaggaaactcgatgtgtatccagcatcactgagtgctcaggtctgcagactgcagagagatgtaatgcttattcctgttcccacatctttgatctttttgcgtgaagctaatatttgagaattctttatttccctggagtgtcaaacctcctgtcaactcgccataaagacaaggaagagatttcctttttcaacaagtgaggacagatgtggccaagcgttgattattattgtaagagatgaatacaaatgttatcattactgagtgctaagctttgtttatttcttcagaattcccctagtgcctctgggctgggaatctcacccacagaccttgatcaatgtcccctggcactttgaacagtccttggttggacctgacagcacgctccagtcttacctttcactggtagcacagcagcgtctaaccgatagggactcttcttggctctgtgtgtacttttaccatcctagataatgaagaccagagccaaggaagagaaagataacaaacgagagagcatatttgattctaggagatttgactgaagatggagatggtcaggtaggcaattcaatggggaaagacacttattttttatttattgacttattttttgatacagagtcttgctctgtcacccaggctggagtgcagtggcacgatctcggctccctgcaacctctgcctcctgagttcaagccattctcctgcctcagccttcctagtagctgggactgcaggtgcgcaccaccatgcctggctaatttttgcatttttagtagacggggtttcaccatattgtccaaggtggtctcgaactcctgacctcgtgatcctcccgcctcagcctcccaaagtgctgggattacaggcatgagccaccatgcctggtcaagacactgatttttaagtaagaccttccaatgagtaatcctttataatcaacattagaactagacgagtattcagaaatgcatgttgttttatatgataacacaaaggactgaatacaaacatcattaaccaagctcttctgagagcttggggaaaaagctgcccgagggtaccctgctttgtgtgcatgtgatatgttccatctgcctgaaatgttcctttgaaataagaagcgagggcacagctgggtaggagagggttgggaaggggcccatggaggactcacctcactgatgtgctgtggaggttcgatgaatacattccccgcttccctcctacccagtgtggcctgatgatcacgactagtgttcctaccagtgaatggttcaccccgaggcaaatgcgttccctaaggaagatatgtgctgtgagtttccagttgtaagaagccagtggagacacccaggtagtctgtgttgttgaagcctcacgatctgggagggcggtgtgatgaatcccgggcagccacacacagtttccggcaataccacatttcatcaattccgtgttagaacattgagtccaagctgttggaaaaagcttccccttcaggtgtgaggaggcccaggcagcagatgccaggactcacactcctgggcatcatttattttggaagttggggaagcaggtgccggacaaagctctgggtcgtcttcttttgcatcccctccagatctcacagggtttcatgggtgccctgtgtttgatgttcagtgtggaatccaagagcctggtgaggagaagctgtctcagaaccagtcacaataaaaataatgatccacagttaacatgcatagagcatttgctttgtctcaaggcatgtgctgggtgcaccattttcatcctcacgggttctgctagtgtcctcatgcatagatgaggaaaacaaagcttagagaggtcaaaagagctgtccgaggtcacccagctggggttgcaatccaggtctgcctgaccccagagctccagctctgaacctctgtgcttcctgacctggcttcagtgcctgtgagtgtcacagtctcaccacagctggtgttaccatagctacttaacagctggtgttgggggagcggggaaagtgcagaaatgaagtttgcgttgttaacaagaaattttgctaattaattttggggggacacattgagcaagtccgcccaggtgcatgttcccacggtcccattccagtgggcagttgaatgcacacgtatgcatgaagggcgtgggtagtgaacttgtaacagcagaggaagcagaaggttaaaaggagaagctaaatacacctcagtgctggaacgttcattttgcagatttttgtcaggtttggcagagaaacctccaagctctaatcttacagggcgactacttgggaatcaatcgggaagcatatttcctgttactttagtgtagcgaaggcttctcctcgttcttttctactcttagtaatgtattagtaaaatgtgtttatgaaaatctgagtttcctcattccacctttatgtttttccttatgtctttataaaatctgtaagttagtttcctcattccacatttatgtttttcctcattctaatgccctctcttgaattgttagttctttgctttaatgacgctttgttaggcctgggctgatcccacgccatttttttatttcttctggtttgatttctgcttacacctcaaagatgtttaccttcatatcttctctttccctttacctgtgacctctctgccttgcctctcttaataagtgttaataatgctgggttacactttaactcactttgggcagtattctaaatcttaatctcttcaaaggaagtgctaatgaaatgtcccaccattatgtatctgtgttctcttacaaatgcagatgaagagccattcaatggagccacataactgcctttcccatcaagccttgaactgcaagtaaaggggcctgattgtgaggagtcagactcaccatctaggtcgcctgacagaggcccctcctaaccctgtccctggacactgtaacttctctaagacatttgatggtgaccaggcactccactcgtccatgtagtttctgggatggattcctctctggaatattagactgcctcacagattaaactgctaaaggaattttgcagcaaaatgaaatagattttggagcattgtttggagattggagatttggactttgttccaaattgcagatttggagattgttccaacaatttggagctgcttctcctccttcttctccttctccttcttctttcttctttcctcctcctccttctcctcttcctcttcttcttcttcttcttcatattattattattattattattattattcttttaattcttcaaaggagaagctcccaagagagtcgatttgtgtgagagggcctgtgactgggcccctgagagttgcttttttttgaattaactgggataacaaaagacaagcaggcatcttggtattttaagtgtgttttcccaatggaaatagaaataaacacaacactgaccaagtattcaacagagggatggctaaacaaactgtggggtatacatggaatagaatattattcagcaatgaaaaaggaatgtcattctgacacatgctacaacatggatgaaccttgaagacattctactaagaagccaggcacaaaaaggccaataatatataaatccacttaaataggggacctagaataggcaaattcatgcagacagaaatagtgattaccaggggatgtggggagggagaatgggtagttaatatttaatgggtacagagcttcagtttgggatatgaaaaagttgtggaacttgatagtggtgatggttgcaagacattgtgaatgcacttaatgccactgaattatacacttaaagatggttaaaatggtaagttttatgctatattcctagcatcattttttttttttttttgagacaaagtttcgctctgtcacccaggctggagtgcaatggcgtgatctcggctcactgcaacctccacctcccaggctcatgtgattctcctgccccagcctcccaagtacctgggattacaggcgcctgccaccactcctggctaacttttgtatttttagtagagacggggtttcgccatgttggccaggctggtctcagactcctgacctcaagtgatctgcccgcctcggcctcccagagtgctgggattacaggcgtgagccaccgtgcctggccttcaaaagtttttaaatgctgcatgtgaaggtaaccttaggagaaaactcttctgcttcttataaactggcgatgctgtgtagccgttttctgtgatcccagagcctgcagggcaaggctttcagagggcacacggtgccctttcacacgagtgatgctgacattttctccagagctgtgatgaataaataaatgaaggaaggagttaagattccttactactttgcatcttggtcaatagtcagtttgtcttctggttaaatatgagtatttttcgtggtggcaaccccgtcctccagctgctattcttacatatactggcatttacttaagtgagccctcttttcaaacaggacctgacctttcctaaaggagctttaaagaaatccatatttcctgattacaaatagaaaacagtgtgctttctcaagggttaatgtgggcaaagcaaagcaatgttggttctaatttaagcacatagtctttaggcttctttcgtaatagttcccttttgtccatttgggctgaaactgcttcagtaagcattttatgaaatcagtgagaaactccagaaaaaggcttctgcctctttttacgagggtcgtatttggagcaaaggagggaagaaaagcatctgtcaatttgataaatcattttcaggaaagaagaagtttcagcaaagtataagatagagttggcaatttaagggaggaaaaaaaaaagagaggagaccatcacatatagtgctatataaatggtttctatagagagcttttaaatatgtaaaataatttcatatatactatctcattagtgctcacggcaatccagtagttattatagagcttttaaatacgtaagataatttcatacatattatctcatttagtgctcacagcaatccagtaaagtagttattactttatgggtgaagaaatgaaggttcagctttattttatttcattatttattttacattttttattttaattaaatttttttttgggacgaggtctcgctctgtcacccaggctggagtgtagtagcaacaatcacagctcactgcagcctcggcctcccaggctcaagccatcctctcgcctcagtctcccaagtagctggaaccacaggcacatgccatcatgcctggctaacgtttccactttttgcagagacagggtctcgctgtgttgcccaggctgtggttcagctttaataagtggcttgctcaaggcctcacagcctgtaaaagaaactaaacttttgcagagcttccttcctgtccatagaactgtcccaaagtcggacgtcctgggcctgaggcacgggtttgtcacaaggggtggctcccaatagtaaaccttcatggctccctgtatgtgtggaatgagtctctaattgtggagaattgagaatggggggggtggttagagtcccttgaagtgttttgccagtgtagcttgtgtcgtgatacctctttgtgtcattgtaagtatgatcatgcccacatctttctgacatggtcttttgcatctgaatttgcagtttcacatttaacagatttaaacagattggtggcccatatgtatctaaaagagaaacatgtcatctccaggaccaactatatcatttgcagggctcagtgcaaaatgaaacagagggactctagctcaaaaatgattaaaagtgtcaatgtagcaacagcagagtaggcaaccaagcacagggcctacgtgctggccagtactctagcctggaaaagtgcaagaccttctgcaggtggaagcttcacagtgtgccttcagggtctgcttttgggctttctgccaatctggctacatacttaccctttgacacaatcaagggcaaagagttaaaggaaaggtagtcttgaggcctgaactctcttctaaccctattttttttcttcttttgagacagggtctcagtccatttgcccaggctggagtgcagtgacacaatctcagctcactgcagcctggacctcggctcaggtgattctcctacctacgcctcccgagtagctaggactacaggcacatgtcaccacatccagctaatttttttttttttttttgagacaagagtctcgctctgtctcatttgcatttgcatttcagacgcgccaggctggagtacagtggcgcgatatcggctcactgcaacctctgcctcccaggttcaagcaatcctcctgcctcagcctcctgagaagctgggattataggcgcctgccaccatgcccagctaattttgtatttttagtagagatgaggcttctccaagtcggccacgttggtctcgaacttctgacctcaggtgatccacccacctcagcctgccaaagtgctgggattacaggcatgagctgccacgcccggccatgtatctttttaagtacaggtggaggtctcattatgttgcacaggctggtttcaaactcctggactcaagccatctgcccatcttggcctcccaaagcactgagattaccagcgtgagccaccacactggccaacccagactttccactggtacactgtcttcattgctttgatagcaacttttaggctcccttagctttaaaaaagaatcctctaaccatatggggaaaaaaaaaaatcagcaacaactttgtacccacctgacattcggccagaatttttccaacagaacctaacaatagatatgctctctgaaaactctacccagatcgtacactccttgctgggtaggattgtttcagaggatatgaaggacaagggactgagccatgacacctgtcacttcccgtctgagcagttcctgaagaaacagcccccggggaatgaactaccccctctgcctcggggacaggcacctcctggtccacatccatccctggaattagatcggagccacagatgctatcactcctctgccgtggccccatcctcctctgtctggcttttgatgaactgaagactggggtccgggttgtaatggagacttagagttgagtgaagcattttagctttaagaagattattataattatctcaaggcactgaagggctgcttcatttgcatttcagacactaaaatcagagggcagatctttaagaggttaattttgtgagtgagtccttaataacagagggaccaagactcgattctttatgccttaggctaggtttgcagttggtagatgcaaaatatgctgataagattaaagctcctctagtgactcttaagcctcaggctcttttatttgcaaatgtcctgcaccctccatctcagagaactctctaggctccggtactctagaatcccttacagtggatttgcatggacaggaaagcgaattctcatctcttccaatcactgcaagacatggaacggatagtctggcggcacgtctggcagctgaacctcttcactgagaatctaggtaaaggccacttactgatcattataaatgcgctcatcataaagcagtccttctggatttctggcattttcttgaataaacttattgaaacaccctaaggagaactcagacatccttttcaaccctcaggagcggataagaggatgcagcttcatttgttaaattgcagttgcatgtcagttatgaataaacatggactggacttctgatgctaatgtaggaacgatatttgtacctcctggaagtaactcctatagctcgttttcttttaaaattatgcaatccacagtcaagtcctggggtacaagtctaagaggcgtcagccacacaagaggctaaagtgactttggggtagtctgcaagtatctcaacctgtcatttctccagacattcagatatagtacattttaaacacagcactgcctttttcttgaaatatttagtttcagtgttagctaagtttgtgattttttaatgcagaaaaaatgatttatttttaatttctgattcctcgtcgggctatgtatatgtaaagtccagggttatgagaaggcagaagtaaacttgctgggtagaaggcgtcatggtatcatgtgatgtggcttagattaatatgggccagaacactttctctttagacattgctaatgttattcttattcttctactattcacaataatagctaacatttactgagtgcttacagtgtgcttggaactttgctgagaactttataccaattatctgagttttacagaaacattttaaggtagatattgttaatatcccaatttgacagaaggaagaaacaggagttctgggcaggtaaggaacatgcccaagcattgctcactaataaatgactgagctgtgtgtaaacatagttctttccacgtccaaagcccatacttgtaaccactgcactgctgtttgtagatttgttcgactcctcagagcagtaagtcagtttcatcttacttgcctggcctctccattgagtattgaacttggcaggaaatagtgttgggagtgatttgtgatgtctgagataggtagatccagtacagaggaatgttgaaattagacttactagtcccatattagattcttctcagactatccacgagagacttctccatggacccaataccaaccaagcttctgtagaacattttttttttttttttttttttttgagacagagtcttgctctgtcaccaggctggagtgcagtggcgcgatctcggctcactgcaacctccgcctcccgggttcaagtgattctcctgcctcagcctcttgagtacctgggactacaggcgcacaccaccacgtccagctaattttttgtatttttactagagacagggtttcaccatgttggctgggatggtctcgatctcctgacctcgtgatccacccacctcagccacccaaagtgctggaattacaggcgtgagccaccgcacctggcctgtagaacacatttttattatgcagtccatgttcatatgtctagcctgtcagtgggttacttgttaataaaaagcagccgtttcatattagtgtctcattgaaagcagtgcctgttttccattcattctaccttggatttgttttcttcctcaatactgaattcttagaaaatgatatgtatgttgaaaaatacttgagaatacctgagaacggttctctgttgcatttattgctgtatgtgaacctgtctatcaagaatcccaggtgttttgtgatttccgtgtttgtgaaatacattaactctccttatggttggagaaatcaaaacagtgcaggtaaatggtgttttgaaatatctgtaatagtagcgaataagtcagagcctcacagtgcttcattttttaatggaaaatttgaacacatacccacctcttcagtactgaagaattttttcctgtttgattttgttgctgagattggagtttgtcccatgagaaatcactgaacagatttaattttgtttattcttttttttttaagacagcatatttgttctctaccaatatcatccaaagaatgaaatgaatttcaaccagagatgtaggacctaaaaaatttaggtcaaagcttacatataagtggctttgtcttgctggcatcagtattttcgtatttctcttctcaaaagaagataactttatatcaatatttcagaattccatgtagcccaccctactgactgcattgttgtctgttatgctgatacaaagatcttttgttttccttgcctgggatgttctgccatatctcagatggctggatggacacaggtggcctaaaattcctgtgccagattcagcatgatcctgacctaacttggcctggatcataaagtaaaccttggggaatgttcccgtagcctgagcgggaaacactggcctctgggagctccttatggaggagagaaaacgaggagctgtaaactggacaatggattaaaactctagtaaactggctggggtgcagtgtctcacgcctatcatctcagcacttcgggaggccgaggtgggtggatcaactgaggtcaggagctcgacaccagcctggccaacatagtgaaaccccatctctactaaaaatacaaaaattacccaggcgtggtggcgggtgcctgtaatcccagctactcagggggctgaggtgggagaaccacttgaacctgggaggtggaggttgcagtgagccaggatccttccactgcactctagcctgggcaacagagcagataatctcaaaagaaaaaaaaaaaatctggtaaactgaattccgggtcagatcttcagatcttacctcctgtgtaaccttggctaagttaccaaatttctcttcacctcagtttctctgactgtaaaatggagacacaagccagaaaatctttaagttcctgccaagttttaagagtttgaagcttccacgatactctgtgcccaggcccttcctgatgtctgcttttacagcgggacaagcagcaatgctgttgtactctctgcatcttggggcttgttcctctgaacccttgaagacaagggctgagccgcgtcagctctttcccaaaacacaatttaaacccttcggagtggtcagaaatgccactttgggaggcctccctgggttctctgggtgttttgttgaagcagtctcaggttctctaacgttctttttgttgaagatgatatctacaagctttataagctttcttctgatggggagagggaagaggttctcttaaatacagtgttcaactatcaaccgtcatctttagggagacccttcaataacctcagtttctctttgtgtataactagagctaataagagaatgtgggtaaattgggctaaaacaaagccaacattacagtagttcacatgatatttttaaaagaaaaacaaaggcggcacgccagactaaataaggctaccatggccaccgaagttttgcatcaatttgtgaccaaaggacatttttcaaactgacctaagccaatttggtatctgcagttatttttggtcaatatcattagcctcccatagttcaaagtaggtggggctataggttttctcctacaaaaccttgtttccaggtcatgttacaaaggaaataagtcttttatttttatttttatttttggagatggagtcttgctctgtcgcccaggctggagtgcagtggcgtgatcttggctcactgcaacctctgcctcccgggttcaagcgattctcctgcctcagcctcctgagtagctgggactacaggcgcgccccaccacatctggctaatttttatatttgtagtagagacggggtttcatcatgttggccaggatggtcttgatctcctgacctcgtcatccacctgcctcggcttcccaaagtgctgggattacaggtgtgaaccactgtgcctggacaggaaataagtcttaaaccaaattctgccatacttacaaacgtgtagcaagctgacaggaaaagtcctacaattcgttttgtaaacttgatgaaaagccacgcccctatccttttaggcaatcctacagcattttacataaagggtaccctagaggcaagtgcggttattgcactaatggcatgagccagataatcatccagttagtcaagcagagaaaagtgctcctggaatgacctgaacaatggaccaatcagttcaaatccctaatttgattaattgggcttgctggattttatacaagcaagaatgcctgctcaatatttctagccaatcactatatcttgaacataaccattttcaccaaagaaaaataatttctaactgccatgattccagttaaactctgccgttgaccagtaatagagatagccaaggcagcgtggcaacggcctttggagtgtaaccttctgatgagactctcagatgataacttggactggcctaggcactgagcaatcagaacagattctggcctcagctgatgctgtgcagaagcttcctactgagccagaattgtctcagagagctgccaaggcaaccaggtcttgagtggccaagatctgagatagaagggaactatagagagtggagaaggtgcttttctctccctgttcatctgctgagaaggcagcagaacttttggcagtataatgaggcttaaaagacaaaatttgggattcagacctgccaaggcggacaagacttaagagatcaagatcctgggaggaagagacagaaaagtgaactggatactccagtcgttgtcccctttgaagcatttgccaaatattagactgtatactgcaagagactaagcaaaaaaaccatttttagtggagttctcagtatcacagtgctaagtggaaaaaaaaaaatcacatggcggggtgcggtggcttatgcctgtaatcccagcactttgggaggccgaggtgggtggatcacctgaggtcaggagtttgagaccagccatcaccaacatggtgaaaccccgtctctactaaaaatacagaaacttagctgggcatggtggtgggagcctgtaatcccagatactcgggagactgaggcaggagaatcacttgaacctgggaggcggaggttacagtgagccaagattgtgccattgcactccaccctgggcaacaagaccaaaactctgtctcaaacaaacaaacaaacaaaaaacaatcacattcaaagcttagccaggagaaaaggcgctaggagataccccactgggatccttgaagaatcataacctaaaaatagatgtgaacctgaagtagacaagcgatacaaaatctcagtgagctcagtctgggattggtttagcttgatcactcccattcagctgcctaccagaggactgggcgaacgatcactgaagaaagatgggagtctctacctttctcataagttgtttcaatgaaaaatgatcaagcataccaagaaataagcctaaaagaaaaaaaataggcactggaaagatacccataatttactggcattatcagacataaatttcaaaatatctgtgattcatatgttcaggaagataaatgatacaataaagaatttcaccagaaaatgggaattcataaaaagaaactggggccaggcgtggtggctcacacctgtgtaatcacagcattttgggaggctgagttgggcagatgacttgatcccaggagtccaagaccagcctaggcaacacggtgaaactctgtctctataaaaaatacaaaaattagccaggcatggtggcgcacacctgtagtcccagctacttgggaggctgaggtgggaggatcacctgagcctgggaggtcaaggttgcagtgagtcaacttcacttcagcctgagtgacagagatcctgtctcacaaaagagaaaagaaaagaaaagaaataaagaaaagaaaagaaagaggaaattctggaacttaaaaaatgaaataatggatattaagaacacaacaagtggatctaatagcagattagatttagtacaagacagattcagtgaaatggaatgcaaatcagttgaaaatatccagagagatacatggagaacaaaaaggatcaaaatacagaaaagagcagaagagacatatggaacacatgtaacatataattgaaggcctggaagaggggaagagggaatgaggcagaagcaatatatttttctttttctttttagttgacacataataattgtacatatttgtaggtacatatttataggatacaaagtgatgattttggtataggtgtacaatgtgtactgatcaaatcatggtaatcagcatatctatcaactcaaacatttatcatgtctttgtgttgtggacattgaaaatcttttcttctagctttttgaaaacatacaataaatcatcattaaccatattcacctgagagtgctgcaggatgccagaactccttcctcctacatagctataatttggtctatagtttggtatccattaatgaacctctccccatccacctctccttcctacctttctcagcctctaacacctaaaattctacttcaaaatgtgatttaagaagccctggcttgccccaaccaggatatacacagagaaaaccacagctgggtacaatgtagtaaaactgttgaaaacaaaagccaaggagaaaaatgattaaagccgtgagaaaaaaattcattatttttaaaggagcaacactaagacagtaactcatttctcaacagaaacaatggatgccaagagacaatggaacgtcatattcatgggttgaaagaatgtaaccgtcaacctaaaagtttacaaacttaataaagatattcgtcaaacattgaagtgaaataaagacatttcaggacaaaaattgaaagaatccatcatcagtagaccaacactaaaagaaatactaaaaggaagtatacggatagaaagaaaatgatcccagaaatgcaggaaggaatgaaagctgacagaaagggtcaacatgtggttaagttcaaatgtattaagaatatgagatgtattgatggctggatagagggatggataaatatgtgataaagtaaatgtagaaaaaattttcacatgcagaaatgtggaaaaattaaagaatctggatgaggggcatatgggccattctatttttgtaaaatgttcagaaaataaatatagggcaaatataaatgaacattgaccatataaaagaacaaaaatggggttttgtgggcactaaaatatatgtagcattaaatgcatgacaaaaacaatacaaaaagtgaaagggggtaaagggagttaaagtgtaataaaatcataacatctggaagtattaaaactcagaattttaccagactataataggtcaaggacacataatgtaatctgtagagcaactagtaaaataatgcataaaagggaaaatagaatgaaaaatacttgattaatctaaaataattcaagaaagaagaggaaagagaacataaactaggtggactaatagaaaacaactgtaagatggtagctataaactcaagtatatccgtaattgagttacatgaaaattgactaaatactctaattaaaagataattattgttagactgtattttaaagacaacaaaatctaattaaatactgcttataagagacgcttcataaatgtaaggacaaaaagaagttgaagataaaagaatgaaaaaaagatataccttgtaaatgccaaccaatataagctggcatagttctaatataagagaaaatagacttttcaagaatcatcatgaagtcaggagttcaagaccagcctgaccaacatggagaaaccccatctctactaaaaatacaaaattagctgggtgtggtggcgcatgtctgtaatcgcaactactcgggaggttgaggcaggagaattgcttgaaccctgggggtggaggttgctgagagccgagattgcaccattgcactccagcctgggcaacaagggtgaaactccatctcaaaaaaaaaaaaaaagataagtatctttaatttatcattaatgttaaatagccaaaaatatacagaattaaaagaagaaaccagtctgtaatcatagaaacaacatgtctctctcaaaaactgatagaacaggcagacaaaaaatcagttaggagagaagatctgaatctctcaacaatgacacaattcatttccaagtacaactgggacattaaccaaaattgaccatatgttggctcataaagcaattcttgacaaatttcaaaggactaaattcattcagagtactttttttttgaccagagagaaattaagctgtaaatcaatgaccataaaaatagaaaatcaccaaatgtttagaaattaagcattctacttgtaaataaccaacaggttaaagaagaaatttcagtggatttcagacaatagtttgaaatgaaatgatgaaaattttacacgtcaagcgctaactaaccactcacccctgaagtgtgtattcctaaggtacttcaaatattaaataactactcctataatgtaaattaataactaacccacacattattatactatgtatactgaaggactgttatttatttatttattttaagacagaatcttgccctgttgcccaggctggagtgcaatggcgtgatctcagctcactgcaacctccgcctcctgggttcaagtgattctcctgcctcagcctcctgagtagctgggattacaggcatgtgccaccacacccagctaatttttatatctttagtagagacagggtttcaccttgttggccaggctggtctcaaactcctgacctcgtgatctgcctgccttggcctcccaaagtgctgagatttattctatcatattatcattcatctcaaactccatatgtaacttgcagttgatttttcaacattcaaacatcatttattattatccatcaaattgccatcttgttccatttccctgcatatctcctttctgtgtagaagtcttccttctgggagcaggacgaggtaagtgagatgagagcctgggctgtcacactttatattctaatatttttaacccaatttgctttagtgtggtcagagaagctggaaattgaatcagagacctcaggggcaactcaggtgataagtcagcctggatgtgaagtttatcagtcttggctccgtgtgtttaattagaagctagtggaatgttatcattgactccgccagcaaacatcttcactggagaggcagctgggttaaggaagaacatgctgaaaatagagcttatgaacatagctgaaaactgtttatccacagcaaccagcagaagtgaggggcgggagagagcccagcagttggcaatcagagcgtgcatataagcaaagggatcatttcttccaagctgtgtcagagggcactcaatcatgtatactgagctttcttcctgaaaagatagttcaaatctgtgtggattgtcaagttttcttcctctccataatatggtcattaatatttcacttcttttagccaggaactttcaataattcaacatctgctcttccaggctgcctgcaagaaaggccagtttccacccactgccctcctgggtttgtccttccaggtacagaatctgagaggtactggggaaaagaggaggcaacgaggctagtctctcactcctctctcttccctacctgtgtttcttggacgggttcacattcttcttgcatcagatagtaaatgcagtcaaggaactggtgaggaaaatgggaagtttttttgtgcatgtgttagatgggaagaggaaaattggcaagtgttctttaagaaaagcagacacagttacattcatgaggcaaccggttgccagactagtgtgactcctgaaggaacaacttggattgcctttttttttaaaatcagtttttatctagaccaaatctcttttatttcagtgatgtcaagcagctcatgttaccttcgcccaaagagaaagatgtatgggagcttcaaactcaggacaattctcaatgtccttagcgttgactcatattaaaaatgttaagagaacactagaataatagtgatgtgtgtgtgtgtgtgtctgtgtgtgtttgtggtttcctttcctggaaaccctttctaggattaacctaggttaatccaacataatgatagtctgaagaggttgaataaatcagcccagatacgcaggtgatttagccaaggctacatggtgagtctaggggcaaagccgaataagggtggagtccctaattcatagctaacctgcactgccatagtctatcggaagtgaggtagagattattatctgattttattattccgggacacgtaaacttggctgaggacacacagctcggaaccctagcccatagataaatagacaactttatagagtataatttgagtaagccaaaaagtttccacttacatatattctagacctccactttaaagtaatttgagggggacagagaggcaaagtgagcagcatttcttcagaaatcacgttgtctggaaatagctcagtagtgcgcatggcactccgttagccaattgctgtcctgggcctggagggccatagagctggacagaggccttgttttgtttggttcggtttgtgcttgtggtattcaggctggtaggtctgatggctggtaaagtgctaaagcaatcatgggtgcgaggtacacagtggggaatgtatcaaacggtcactttcctaagggagacattctcccccttctaggaatttgctgagggttgggctgagtggaagcgtttccttcctgcctgttctctgacttccaatgcgcactttgttttaggctggatagctacacatcatcaatgagattgcagacagtccctgtgcttgctaagaacggtggaaggttttaggactactgtgtcttacatattcattgtctaagcccccaagtgtacagcattcaaagctattccttccagctctgaaatttctttgggtgaaagctgtcgactttccttagaggaaaaagaaagccatttcatcagggcactgacctcattcctgtaagcttgactggctgagccctgggagtgacacctgtcccagtctttggctttagcaagtgattgatttgaagaaatggtattggtcatttaacccacaaactgattctgaaataagactcatttgtaataaatacatctcacatttgaggactgaattcttcaacacacattccaagttttgtcagttagaaaaaatacagtactttgtaaagtataaaatccataactctatataacccaaacaataggttgaaaactgggtttgttgtaagtaacgtattaataacacctggtgtaatacctgttaacatgctcggtgcctgaagcaaattggcaagcgtttcatctccttttgccaataacttgtcagaaactgactgagggttccttccaaactctcagaagaacatccaaggccaggcagcttatgtagctcttgaacttcaccagggcgagggctgggccccggccaactagagaagccacagctgaatcagaggaggaattccgaagagctgggcaggggcctcctgatggcgagatgctgaatgggataagaatgtgatgaattaattgatttgtatcttacgcaagagctgcagtgaggatggtgaaattcatttccttccataggtcctgcccctttctttgtaagtcagtcagcagcattgccagagctgcctaaaatgccacctccatcccctgacaatcaaagaggaatcttttcatgcaggctgagttctaatgacgaactcattaaaatcaagaccacttactatgcgtatgtgatgtgttataagcactttcagatgcatgattttaaacattctggccatcctgtgaggtcagtaccatattatccccatttcgtggacagaacagtcgtttagagaacttcagtaatttactcgaggcaatctggtgtgaaaagtttgagagaggacactgcaaccaggccacctgggtccagatcttggccttgccacttacgagctatgtgaccttgagaaaaggtcttaacttctttgtgtttcaatgtccttatctgtagaataaggataatagtgttgcggatgtcacagagtcgtaatgagggttaaataagttgatatatagacagctccgagaacctggcctggcatatggtaaggactagctacttatttgtggtggtgatttgtttttactctgtgagagatttgaacccagtttagtttgatgctagggtcagagttctttgtcatctgttcttaagaagccagtggaataaatatcttctttctcctacatttacaaagagatgataatcctgctttagaagagttatcatgcctgcagaggtatcatagagattagtttttatccgcagagcactttttaattggaggataattgctacactggactagtgtggtagtaggaattcatatcaaaattagactttgtgactgaaagtgtaaacaaatgcattcttgctaagactagccacatatttagaggcatatagcagtctgaaataattctattcctttgtcaacacacagacggaggaccgttgggccttttgctaaatttggctctgctgcacttccgtctttagaactaggcaattgcttcatcatgcctacattgtgctaccctgatattttggtacctactgcactgccgcacattcatgggacgccagctgtaccatctatataataatctgagaacttggccattcaccatccaaagttttcatacaaaccaatgaaggcggcgtgcacttcagatgagcaaacaccagacctgtagtataggtggacagataactagattttgcttttctgataaaaaaggaatcttgtctgttgttttagaactactttatatggacagtgagtgcagcatgatttcttccaactggagatttaatggagacctggatcaaacattacatactttgttacatctttttgagaatgagttggagtgaggggatgttatgttgaaaaagaagaggcaggctgggaagggtggctcacacctgtaatcccagcactttgggaggccgaggtgggcagatcatgaggtcaagagtttgagaccagcctaaccaacatggtgaaaccctgtctctactaaaaatacaaaaattagctgggtgtattggcgcacgcctgtaatcccagctactcgggaggctgaggcaggagaattgcttgaacccaggagggggaggttgcagtgagccgagatcctgccactgcactccaacctggcaacagagcgagcaagattctgtctcaaaaaaaaaaaaaaaaaaaaagaagaagaagaggcaacacttgtcttggcaaaccatgactagtttagactgcaagctcaatgaagatcaaaactaggttggtcttgttttgtttcaggcactctctgtatgtatttgttgaatgaatgaatgaaaataatagttatgattataatattatctaagtatgaagaacatgcctctggatcagtaaagacacataaaatggtaggagggttaaagaacatcagtgggtaccaactgttttgtcatgacagggggatatctctgaaaaatttctgtattaattggaaaagaagcttatggtgaacttttttttttttttttcgagatggagtttcgctcttgttgcccaggctggagtgcaatggcgcgatctcagctcatcgcaatctctgcctctcgggttcaagtgattctccttcctcagcctcccgagtagctgggattacagacatgcgccaccaccccggctaattttgtatttttagtagagacggggtttctccatgttggtcaggctggtcttgaactcccgacctcaggtgatctgcccgcctcggcctcccaaagtgctgggattacagcgtgagccaccgcacccggccatggtgaactctttttaaatgacacataaaatttcctgatttgtcttttaaaagttacatctagattttcatgtatcatttttcttataaggatagctaattaatatatagattttatgtatggattttcatatttcatgtatataacatgaattaaactgttatttgtatgaagtgccaagctccttttgggtagtacctaccaccctgtatataccacatgccaaatgagtttttaagatattggcatgtcccaaattcaccatttacattcttgaaagtacttcctttgttccatacagatctaactaaatattagaggtatctgaccttttattttttgaaaaaatgtttgatgttctgactatttgcaacaaaagagctctgttctcaaatgccctgtatggagagaatttctcggttcttttgagagggataaaaaacctctcttaagtctgtgagactaaagataaagggcatcccagcaccatgtatctgagggataatgactgtccgtatcggagagctgggcggtgatgggtgtgttggaagcaccggctggaccaatggacttggagctagaacttggttttgctctcggcgttgccgcagggtggctgtcttgccttatgcaggttttgattctcttctgtaaggatctggtagctattccaaagccaacccatctgtgctatgggatttgatgccacatgactccagctaccctggtaggcctttcccaggcgttggtcagagatatgatccaaaggctgtctgtagaagattgttctctcctgagtgttctgatgcagccagcacaagggtttcctaaggaaaggaacctggtcctgcttcggtcgttttcgtatcccctaggggctgctgaataaagtactagttcccaagctttctgtcatatcttctctgcacacttctggagtagagtgggtgagggcaaggccaggaggtcagtgccacagcgtgggaagagaggaggccctgggccctattctctctggggagctttacatcacccattgctctctccatctccccagggcccagatggctccattctagagcttctcctccaaccccttcccaccttccatcccaaacactttcctctctccttcttggtctctctctctctctttctctgcccttccttccttccctccttccctccctccctcccttcctctctttctccctccctccttccctccttccctccttccctccctcccttcatgttttcctttcttccttctttctttttctttttttttgatacagggtcttgctctgttacccaggctgaagtgccacccctgtgatgcctagtggtacaaacactgctcactgcagtcttgacctcctgggctcaagcaatcttcctgcttcagtagctgggactgcaggtccacaccaccactcccagctagttttttaatttttttgtgcagatagtgtctcactatgttgcccaggctggtctcgaactccttgcctcaagagtcctcccatcttggcctcctgaagtgctgggattacaggtgtgagccactgtgcccagcctctctgctctttcccttccttctcctcttagttaaaattgtagccgtggtcagaggtggctctgtctcctcgtagaaagcagggagcaagactacaaaagaaatggtaaaattttaacgaattttaaatgaataaatccctaatttcctatggaatgacaaactaaatgatggtttgtagttggaaaattaagcaataaaatacttttttattttttgagagagagtctcgctctgtcacccaggctggagtgcaatggcacactcttggctcactgcaacctccgcctcccgggttcaagcgattctcctggctcagcctcccaagtagttgggattacaggcacgtgccaccatgcctggctaatttttgtattttagtagagacggggtttcaccatgttggccaggctgttctcgaactcatgacctcaagtgatccgcctgccttggcctccaaaagtgctgggattacagacatgagccactgcgcctcgcctatttttttttttttaataagtctataataggtatacacagggcctgactattccagatagtgtcagctgtgtagttttcttattagcagacttgggatctatatttatagacaattgaagttttaaagatgtaaagaatttatttattcattcatttattcttttgagagggagtcttgctctgtcgcccaggctggagtgctgtggcacaatcttggctcattgcaacctctacttcccaggttcagtgattctcctgcctcagcctcccaagtagctgggtttacaggtgcctgcaaccacgccctgctgatttttgtatttgtagtagagacggggtttcaccgtgttggccaggctggtcttgaactcctgacctcaggtgatccagccacctcagcctcccaaagttctgggattataggtatgagccactgcggctcatacataaagcattatatacaattgtcattatatactgtaatgtaccttcattccttctgtctgaacaatgtggattttagaaataattaccaaatataaacactactaaaatgtgtagatttggtggtgcagcacatcaaggagcacaaattttacaaatttctttttaaccatctctgcgttgtattttcagaatacggatgattcattttaatcctggtgtctttaaatgattaaggattttcatacatgaggtatttcccacagggaaattctaaggtaatttgggtatgattcgtttagagtttttcattatttacaacaatttagtaaccattagactttcttccttgcatgtgaatacatacatatatttttacatcaagtatttccatcgaattttagctgcttatattttctttttaaccattacttggaatggtattttcctataagcggggaataaagaaactacttctgtctctcgggtatattaacagggacagtggggcctaatttcttatgtcccctcagttagcctttgtcacagacactcctgtgttttggggtcaggagggaagagatcattgcagactacagtcatggaatttgattcatttaactgaaaactttttattttactttacccatcttaagtcctcctgatagccctataaagtaataaattgtccaaaccccttcaggaaactattcttaattccatcatcatttatagttgcctatctgcccaataaaccagaatttagccttaaagccatcgctctcttaatctgtattatgatcttgtctttatatatgagttttgtttttcaaattagtggatggccttaggtaccattttgttattctgcttgtttgtgtcttctgaagacagtcacagcatcatagaatactacagattggaggggtctatgggatcatcagaaccagtgcttttcaaaaaaattttaactgcaaactccccatttgaagtgaatttttgtttgtttgttttgtgacaaagtttcactcttgttgcccaggctggagtgcagtggcacaatctcagcccactgcaacctccacctcctgggttcaagcaattctcctgcctcagcctcccaagtagctgggattacaaccatgtaattacactcggctaaatttttttgtatttattagagattggctttcaccatgttgaccaggctggtcttgaactcctgagctcaggtgatccacccacgtcggcctcccaaggtgctgggattacaggcgtgagccacggtgcccagcctgaagtgaaatcttataagaccctcagtattggtccagggagggtagacttcctcatacctcccaggaggcccgagggctccattgcctctaatttcctctagatgagagaactgacacctctagagataaaattagctgcccaacattttggtgagggaggaagagtccatttttgttgcttagaagcttcgaaatcagcagaggtcagtgtatgtggagattgctggtaataagtctggaaacagagcagaaggttgcaggttggaacctggcttccctggaagccaacactcaggtggagctgggcatgcaggatgtttactggaaatccacacccgtagaaaccaggaggatgcaggattgtaccaaggaaaaagtcaaactgccacacaggccaacaaagccttggccagccccacagggaagcgctggagcataaatggcccatcctcgtgtcctgtgttggacttgatggctgggcctttataccctcactgctatcagtctttggatgtgaaccaccttgggaagggcaggcccttggccttctgcagcattctgtggctttcttcagtggaagcaaatcctgaagaagctgtcagctggaagccaattgcccacagctggggcaacaagtcctcccttgaagcaagatctagaaggcacatctccatgtcccctccacatggccccaggattgctggtgaacatgagagacagtggagaggagagtcccgggaggcagccttcccagccaggccaccccaaacttctggttagggattcccagcttcacagcactacgtaagctgcttgccaacagatgttttgacaacatctgttgtcaaaggttgacaacaacctttggtccttgcgatggctttctcctgtgtttcaagatggattcctattggcatctttcatttccacctctgtttcaccaagtttagtgaccattttcatacattggggcttaatgtggtgcagtggaaagtgtagcagattgaatgtggaagatcgggttccagatctcgttcaggaagttagtagctgtgtgaccaagagcaagtcgttcagcttttctgagccatgattcctcaggtgtacacaccaagtgatgaaacactttaaaaactaagaaaacagtgtttgaaatgcccctcaagtgctggtgtttccccaaggatgttctagacccttcaccattccattcattcattcattcattcatctattcgatgattagtgtgatccctaacttttttattgttgttgttgagacggagtctcgctctgtcgcccaggctggagtgcagtggcgcgatctcggctcactgcaagctccgcctcctgggttcacaccattctcctgcctcagcctcccaagtagctgtgactactggcgcccgccaccacgcccggctaattttttgtatttctagtagagatggggtttcaccgtgttagccaggatggtctcgatctccttacctcgtgatcctcccgcctcaacctccccaagtgctgtgtgatccttaacttttaatctacagttcctcttttttttttaagccaagtagatgggtgattttgttttctgctaattattttggtatctttcattccacctctgtttcaccaaatttagtgaccgttttcatacattggggctaaatgtggtggtcgttctccagaagagtgagtgtaagttcgctcttactttgagcagcttatctctgtttaggcgatttctttgtcaccattaatggaagtgtgacacctttctgagtcccaaatgtatcggtttatcaaaaaccacatctgcaatgctgcaccttgtactgagttcacctcagtctggtactttctttgccttttgtcttgtttgcctccttgttagattagctccttaaaactttttcttttcattttccactaagtcataactctctagactaaatcctattaaagaaacatttaaagtgtttctttactgtgaagtgtatcatgcatgaaaatagtgtgtgaaatggaggtagatgttcagtttaaagaccaatagtagagcaaacgtctatataccaactcctcaggttaagaaatcctcttgtgatatatttatgcacgtggagtagctactttttccagaatttggggacatgtaatgatgactgagagatcatatagtctacataaaacagctcatcatcctagaatgagaaagagagaaaccagccaataaagaagggcagtgtgtataggtacttacaatgagaaatacaaacaagatgggattggagccgttctctatgtctgggagagttagaaaagtttccaagaggatgagacttttgaaaagtttccaagaggatgagactttttaagggatggtttgcctgaggaagatgagcgttccaggtaaagggaacagcatagcacgtgtagtgattcttctccctcctcattcccctctcaccattctgaccattcaccttcagtttcgtttccactctcctatcctccataaatgttggtgttcccataggtgttgcattaggatctcttctcacgtcattcaattttcatccattcacttgctcaatgtcaatgaagcaatgggtctccagaaactcctgcctgcagaactatctgtggagcttggtaaaatgcagatggtcccaccagctcaatcagaatctttggggtagggtccaggtatctttagtgcagatgactgggactccacatggagaaacacaggtgaacagggagggttggagagaccactcaggaatcagtcacaggtgaccttgtgcttcctgctaccatggctgcccctcccagcctgcctcacctgtgcctttctcccttctcccttcctgccttcagctcctctgttgcttcttcttccttaaacatcttcaccggttcctgtgctattacagagccccgtctgtgggtctcatgtctctgctccatgccacgccctcccttgggcatcatctgggctttggctgggtctgtggagggtcctgggctgcagtgccatgaacagtggagtggggcatgcgaagttgacagtcacactgaaagctcctgcctcgcctctctaccttcttctcttttgggggtttctttcctgaggcagggaaaaagaaacaggaacccagaccaaactgaggaaaacacgatcagagatgagatggggtcagaggcaaagggctgtttgttgggtttgcactttcattactgagagcattggaatagttttaaggcgtgcaaactgtgagactagacaatttcacttagaaaatgaaacgtgcatgcagatgttattctcatggggatatatatctgcatctgtttgtctacaagtgttcccttgcagagtcacagacatatacaaaacctgggttccatcagctttgtctgcacatacgtggctaaatgtgtacagggatgtacaattaaagattttaaacacttgattttgacagtatattttgcagctgctgtgccaagaaccctaagctactgtgggttaattggagttgtagcaagtatttctttctcggctgtctcttttagcagagcttctctctctctctctctctctctctctctctctctctcttcccctctctccctgtttcacccctccctgcctgcctgcctctgcccctccctccctccctccctctctctctctgagatagcagacaccagagtgaaactggtgcagcttcctttgagaagcgtgcttgcatgtgcggattggcaggattgtgtgagctcctctcccatccatgcactgttcttggagggaaatgcaatgttggagcaggggctgagctgcactgggaaggtggctgggagctcagtgaggccaggatcatggtttagccaaaggctggaatcacaagaatgtttcaccagggtctgctctgagagttctcagacccccatggattttagaattttccagcctttcctccttcaccttcgcacaattttactttctcctgagatggccccagatctgcaagagacatttgagagaagctatttattagcagacgtgaagaaatggattctgcacttgattatttagccatgacttatcaatgatgatggattggaaagcagtgtaagtaacgcagttatatatgttgctggagttaggtggtctgttttcttgctattttttttttactttaactttttcagtttccttttgagaaaagtaaaaataaaatgcataaaccatttcaaagaagttaggagggtccaggttgtgcaagctttcttcttgttcaatggacttgcagaatacctagttctatcagaagagacacacaaactaccgacatagaagctacaaacatcctccggaggatgggaatgaaatgggtaataaatgaagaaggtttctgaactgacagtcattgctataatcaggcttattcagagttgctaaaatatttgacattggctcatattagaatcaaagaactaaaatgtattctctttacaggatcataaaaatgaagttagcctgtggctttcagagcaggttctttctggctgcgtaaatgtgagggtttttgtttgtttgtttgtttgtttggttttgttttttaactaatgtcaaatgttgactatgtttcctgtccatttcaacttttcttgaggtcggacatctccctattctagagtacaatgtctggtcactcttgggttgcaggccactgtctagtggaaagctagtcattgctagtttataccagtcagagacttttccatctttctgtgtgagggcttcgtttaagcacttcaattcctaagtattcagggaggaaaaacaagtcacttgaagaccaaaatcagtttatttcacaagagaaaggaacggctatttaaaagatgaaaaattgaaatttaaaaatatgatctgccttttcttcaaaatctgaagtgaggttaattttgtgtaggaagagtaacataagctttcttgattaaaaagcagtatttagaggaggcttttaagatcataaatcacttaggtaaggtcatcaaaagagatggctgatattttttatggtcatttgcaactttttaaaaaaagtccatacggtaatgttaatgcagctatttctggcttcttaaaacttgcatagatttggaagtgggatttctaacaataagagtcgtgagtttttctgagctatcattgcctttctctgtctatcacattcatacctcaggcagagctactgtccctcccacctgtccaccctgcctgtttcccagcccccatccttctctctgagtcttggaacatcatgaaagactcttctgcagatttccttttaacataccctgcccagccttggacagagggagtactgtgaagcaacatgcagggctgccaattttggaaatgaatgagcttagttgattcctgaatattaaatcagttctgtgagcagtagaatgagatcatatcttacaaacctgacccaaagtgttcctaacaactttattaattggggtttaacatcatcaagggctgtagcactgggcacccgaggggatcagcctaaacccaaatgaaatccccaaactccactcggattcctgctggccaaatgcacctagggccacgccttctaaaatatgtcctttgttatcaagggaaatctgagacagaaaacacatgttggcagcatcatgtgagcgcctctctgcacataaagtggttgtatcacaaggggaaagctttcgatcttgtgccgttttgttttggtttcttgtttatgtggactctgttagactcctgcatctggaagaggcttgaagcagagtggaaaacctagagcaaaaatcatgccggggaaaggaaaatcattaaaaaacaatgactaaaaacagaataattttcttacccaaattccagttctcatccttgttttgggttccctgttaaagcagataccagttatagccttcctgggttaggggagacagacagtctttcatcatgcccctggattttgagcaaaggagaaagcttgctccagaaatagaaaagaaaaggcaaaaagaaaccatctttcgagtttctgctcactaacagaggaagcaaccccaccctcctccacaccctcctccacccccacagcttgtgcctctcaactgcccctggtggacagctccaacctgcacccccccccaaccccgccgccccctctagaatctcacgtgttttcgtggaggaccgagagtgctttttagcagtgaatgagcaaagagaccagatatgctgatacctgcacatggtctttgagagaggcagctgattgacatcgggaaaactgctgagcaattaaaaaaaaatactagagtcaaggtgaaagaaaggagagaaagagacagcgagagagacaggtgggttgtctctaaagtttcaagcaaagttctgtgaagcacctagcaggtcaaaactgataagggcagatggtgaagaaaagtcttaaactgatcagtgccttacacatggaacgaagctttcatttcggcccgatgttctgccagaaagctttgcttgagatccaccgccagtgttcttgctttgctcaacgatcccactatgctggtatgttctctctctggacagccgtctttctaacaacgggtgctgttctgaaaagctgggagcccaagaaatgttgtaaaaaccaagcgtggccttcagctgttggaccctgaggaacagcacctgcattagggccttgctcacgtttcttactagacaggttgccagctctcatttttgccctttgtctgagctaattggccttagtgttacatcggcccacatttttctccctgtaaactccattcctccctcatttcatctacactgcagagaactctcaagctcctggtgagttttgctgcaaagcctgtggcacgctgaaagaatgcaccccttccgaacctcatcttcccacttcttccactggagacactgcgggggagaaacatgtaaatatcgttaataacaatgcatcgcgtccttgaaaattgctgctaagagagtagattgtaagtgttctcaccataaaaaagtatgtaagataatacatatgttaattagctcagtctagctattccacaatgtgtacatattttaaaacaatgtgttgtacatgataaatatatacaacttccacttgtcagttaaaaaataaaaaataagtccaggcgcagtggctcacacctgtaatcccagcactttgggagtccgaggcgggcggatcacttgaggtcaggagttcaagactggcctagccaacatggcaaaaccccgtctctactaaaaatacaaaaatgttagccaggcatggtggcgggcgtctgtagtcccagctactcaggaggctgaggcaggagaatcgcttgaacccagaaggaagaagttgcagtgagccaagatcctccactgcattccagcctgggcgacagagtaagtgagactccatctcaaaaataataataataataataaaataaaaaatagacatttatataatgaaggtttttaaaaaagaaaattaaaataaatttggagaatgacctgtgaaaaatgcctctgcaagttttcctgaccagaggaaggacttggcttctctcctagacattttttctcgtatcttcctctaggagtcagtggaagagtggcgattaggtaacatctgaatgtagtagaacccagagctgttacctccatttgagctactgctggtcattgcttgacttctattctctccatcagtaaaatgcacgcgaagcttacctcattaggtttttcgagaattaaatgagataatgcatggtgcttagcttagcgtctggccatagccttgatgtcaatactgtcctcatgttctcctgtcagcggtaggtctgtctctcagacactttccaacagaggacccagatccttaatgacaggggacctgggaagacagggaggcaatgtcacagaatggaaagcgtgctcgagtagaagtcaagacctgggtgtttgagtcccagctctgtgcataaccatttgagtgatcttaagaaaatgatcaccccctcttccatgctacagccctagatgggttactccttactccaccactctcctcaccttgactcgtgccggtccctcagcacgacgggtcctcctcctggctggctcctttcttctctccttctatgagactcccctgatcccctgagcccgagggtcagggcttctcctctgccatcctatggcacctacatctctccacgcttaccgtgcagccatcactgtctgcctttcccactcgactgtcatctctgtcttaaagctctgccttcggtgtcaagaccgggcagcactcaatgaatgtttcccgaacggatacgtaaatgacagaaggaatggatgaagagtccctgccctgcctcaggtcttgagtgaagatgaaatgaaataatgtgtgtggaaggcttggatgagtagagtgctgtgcagttgccttcagttttaagttagtatgaggacaaagcattttttataccaatattttagttggtttctcagatactgagattcacacattttagtgaaacaaaacaatattctcttttataccatccttgcagtgtgggcccattatttgttgtagaagcaggccaggctttatgtgggctagaacctctgatggttgaaactgtgagcaacaaaacttttcattgcagaatgacaggtaagattctgaaagccagtggcatgggagggctcgctctgtaactcggcttgtcccagggtatgaatgagggagttcagatccctgcctgtgagggtggagaagggaaaatggtttctaaaagcagaggaggaaagagaaagaatcatcatggaggcagcatggtcagggaaggggcagagggtgttgcatctgacaaagctgggtttggacgatagcctcatacttgggtttctgttgtatctcatgagtcctctccctggaggagtatttggattctattctgcttctcccctgagtttgttttcacggtgggactatccaggactaaagagaatggcaccgtattgctctctctttctgaacccggacttgcaggccatatctggatttatcctttttatcagcagaatggtacatttcccatagcaatgcttgaactctggtccgtgatgaagcaagctcttccatggtgttagagtctgtttttccttcagaaaatgctatttgcagaacggcaacaacaaaacgtgtaacaggaattgtccgttcccatggccagtcctcatgtagagccacaagatggcgcagaggatgacatgaaatcatgtacgcgagcgtgatttgctactaggcagctctgtagggctgtatgtattgatatcacatgcgtctatatgaacgccccgctgcagctgcctttgctatacagtgaatacactgtgggtctattattcgcctcttcagatccagcccaggagttggtgcagactcatttttcactttcctttgaccctgggtgtctccacaaatgaaccacctgctgtgtcttggtgggggtggagatgtggggtgaagtaatgagcccgcaaggcctgtctgtgcctattggctgctctaaagggaagttgaggaatactgcaaagccacaaatctgagatgtcagctcataaatctgtaagctccttgcttaagtaatacgctccttgacggccaaaactgtcatttgcacattctcttcagctgaacacaaaagttccggttaccagactgtccctggatactggggactaaaagctggtgattggcggagtttgggggtggggagggggcgctgggctgattgccctggctgctccccacagctccacggctgctgctttcacccccacctgaccatggtcgcagtggggggctttctcttggtatttaattagtaagtgtaggcaaacatttgcattgtggcactgggataggaaaagagttgaacatgaatataaaaatggggatggggccgggtgtggtggctcacacctttaatcccagccgccaaggcgggcagatcacttgaggtcaggagttcgagaccagcctggtcaacatggcgaaaaccctacctctactaaaatacaaaaacattagccgggcgtggtgacacgtgccccagctagaggcagggaggctgaggcaggagaatcacttgaacccagaaggcggaggttgcagtgagccaagattacagcactgcactctagcctgggtgagagagtgagactctgtctcaaaaaaaaaaaaaaggaaatgggagaaatagtttccagcatttagcttttggcgacaatgactaaatcaatacaaatgttaatctctgttgcattatgcttttgaaactgtattggcagtttaggaaaaatccagtcaacagtttaatatgaaaatagagacctgtagaccaaatggagggcaggaagcagatatttgccacacaaacatttattgagcgcttgatgtattataggtgctgtgtaaagttttggagattcagaaatgaatcaaagagaggagtgaacatacaaattatcccaactataataccggtgataagccacaaggtagctctgctagcacggaacatatggaagagatgaataattctgcttcggagggaaggagtcatattagagttgggtctagaagaatgagcaggaggtggctgggaagggagggcgtttgggcagaggaattggcatgattctctgtgtatgcacaggaccatgaaagtgaatggtgtcatgtaatttttttttttttttttttttgagaatgagtctcactctatcgcgcaggccggagtgcagtggcacgatctcggctcactgcaacctccacctcctgggttcaagcaatcctctgcctcagtctcccaagtagctgggattacagacgcctgccacaacaatcggctaatttttgtatttttagtagagacgagggttcaccatcttggccaggctggtcttgaactcctgaccttgtgatccacctgcctcagcctcccaaaatgctgagattacaggcgtgagccaccgcacccagcaggtgtcatgtaattttattcatatttcctgatgactaagacaacgtatttttcagattctcaaaacaggcaatgattagtaatagatcaccttaaataggatgttataatggtgatgaagaccaatcacagctgcctggaaacagtagatcatgggtcaataatgggcccacacctgggttttgttactgagtcaacctacgctacttgttcatgttgtacctatttatcttgagctggtattagtatatccatttctaaaaatccttgcttgagaaggaaaaactattcaggagaaagaagaggagataaagtctaaacaacttgatttcacttgaaaagtcctaagtcgtcccttggaaactatctatagtaaaaagcatgggattttataccgtgttttaggcaactgaaaggcttttttacaattgtagtaaacactgactgccagcattctggtaccagttactttattaaggtaaattcccaaaactcacaatagtgggaaaaaatactgataagccttctaaaacaccaaagaagtgtagaacaacatcttggatgcttttagtcacgagtcagaacgccgcggtggttacagagcaatagcatttcagagctgggagagaccttagagatcatgtattttgtggattttcaaatctttgaagaatgatgttctgggtaaggaagctgctaagagtccatgagctagttagtgaggactgctacactcttacacactcactcccggatccctttgtgcatgatttctgtcattcaaccagtgttcataaagcccttgtaacatggaggataaatatttgaataagatactggctttaccccgcagaagcttagagctttgaaaggaggtaagacatataggtaaataatacacataggaagttattttaaaaatataatgagagttattagagttcagaagatggaaacttatttcctagtgaaatggatgactgtgtcctgtaatagaatatttactatatttagtaacagatttatacagtctcatttgttttagttaagaagtttgagtatccaacagagaaaaaaggttaggtaaaaattaagtacagtgaggccaggcacagtggctcacacctgtaatctcagcactttgggaggctgaggcaggcggatcacttgaggttagaagttcaagaccagcctggccaacatggtgaaaccccatctctactaaaaatacaaaaattagccaggtgtgatggtgggtgcctgtaattccagctattctggaggctgaggcaagagaattgctttaactcaggaggcagaggctgcagtgagtcgaggtggtaccactgcactccagcctgggtgacagagtagaaccccatctcaaaaaaaaaaaagaaaagaaaaaattaagtatagtcatgtgtcactgaatgatggggatgtgttctgagaaatgaatcattaggtgattttgttgttgtttgaacatcatggagtgtacttccacaaatctagatggtatagcctcctacacacctaggctagagggtaggactgttgctgtactgaatagtgtagccatttgtaacacaatggtaagtatttgtgtccctaaacatatctaaacacagaaaaggtacagtaaaaataagattatcttatgggaccaccagtatatatgtggttcgtccttgactgaaacgttatacggtgcatgactgtatttggtttagcccatgtttttattttgaagaaatgcagaacaagtttaaaattgaattgttgaattgttgtcattagttgatagcctaataagaacatattgttcaagtacaagaatatcattgatttaattaccctgaaaatataattttgaaaaatatctacattttttaaaaattaaattttcgtagtgtaaactaaaattaaatactcaactaactgagagagagagagagagagagagagagagagagcccttccccagctagtctggcagcaagtgatttctaaaggccagaaataggaaaaaaaaaataatcgaatcaaattgacttttggaattgtccttatgaagcacaagtctacaacctttaactcatagagaacacagtgagcatatctgctttgactggcaacttcaaaaaacccctctcccagaggcttgggaaaacacatgttggacacagactaatgataatgtggaacaattattacaatgaacacaataattgtatttgttttatgaacatgatagcctgaagaaacccataccaagaaatattttacgtgttgtcatcattaagaagtcagcaaaccttaaagacaaacacaatctattcatccatccatccatccatccatccatccacccattcatccatccatccacccattcatccatccatccatccatccatccatccatccacccacccacccatccatccatccatccatccatccatccatccatccatccatccatccattctgtaagtgtttattgagtatccactgcatagcatgcaccattcctggcagttaagaaaataaaaggcctcactctcatggaacttacatcagaaagggcaatattaatgatcagccctgaccacatgcctttccctattaatgatcagcccggaccacatgcctttcccttagggaacattgtaggatgaatgttccctgtggtctgaatgtttgtgtctccctctaaattcataagctgaaatcctaacccataagatgatgtcattgtaacattgtagggtgtattttagttggtgtggatatggaggcagaaaagcaaggatactggtgaacctggggaatgcttaagaggttggactgtgctgtacccgttaaaaagcaataaacaggctgggcgtggtggctcacgcctgtaatcccagcattttgggaggccgaggcgggcggatcacgaggtcaggagatcaagaccatcctggctaacacggtgaaaccccgtctttactaaaaatacaaaaaattagccaggtgtggtggcgagcacctgtagtcccagctactccgaaggctgaggcaggagaatggcgtgaacccgggaggcggagcttgcagtgagccgagatcgcaccactgcactccatccagcctgagtgacagagcgagactccgtcttaaaaaaaaaaaaaaagcaataaacagaatctcatgcttctatacaataaaaataaccatcttccctatagatgatgaagagtctgttaatataatctgacaggcttgttttggaaaatatttagatacttatacatccagatatattccaaaccatagccttgtaaaacctctgagctagcgcaatccttgagtataagtctacctccacctagaccaatgtttccaaaccattctgtggctgggaagactggaaggacccccaggctgaccctgttgggaagacatgcaacaaggcttacttcttcagtggtgtcagtgattttgagccagttctgaccatccactcatccgtctgtatttgtgtagtgctcactatagacaaggcaattttggggaatgcagttgtaggaaagatagacatggctcctgaccttatgaaatgttcagtcttgtgaggaagacacaaataattacagcccattgtaagaagcggtaaggtgcttttgtacccttttggtccatttttctttttttttgttttgagatggagtcttgctctgtcacccaggctggatggagtgcagtggtgcgatctcggctcactgcaagctctgcctcccgtgttcacgccattctcctgcctcagcctcccaagtagctgggactacaggcacccgccaccatgcccggctaattttttgtatttttagtagagacggggtttcaccgtgttagccaggatggtctcgatctcctgacctcatgatctgcccgccttggcctcccaaagtgctgggattacaggtgtgagccaccgcgcccggcctggtccatttttcatcttgaccatggaccacgctggtagatgcctgggggcatgagggacatagcaatcaggctctgtcagcctttgtgaccagcacaacttatttccagtgcattaaagaaaatgatactgcctatgcccaatttagatgtgggccagctgtgttagttagcttaacacagcattttgttttgcatatgtattgattttgcgcacatgctctctaagtgcctcagaacactgcctacagcatcctggtgaggttgacaatcagttgtcctgtccctgttcatctggcatggggacacactgtcagaggaggaactaccaagtaagtaattgcctccagcacacaaaaactgcagacacatggttgacataagaatctagtttcagctggtggttttcagggcaaagcaactgcactaacaggagatttccctgacagctgatttaaggctgtggaagaccccagtttatcagctcaaattgagaatgtccttttttgactagaaacgagaccctcccagccaactgcacaaccaaaacttatattcaggatgtccaggacctgaaactgacatgggagtcaatattctacagccagttgtggtgtcgacagggtctgggggaaatcttcagagctgacttgtgatgtagcagggcttacagcaaaggcatccctttcaccttgctctttaggattcatattctaagaagctgctaagaaaaaatgtctaaacggagacacttaggatatagttttcatattaatgttttattttaacaataatgggagcaaacacctaccaggtgtttactctgcgtcaggaactgttctgataatcttatttgaactttgcaacaattccatgaggctagctactcttaccatcctgttttacagctggggaaactgtggcacaggaaagttaaggaacttgaccatggccacagagctctgagtgtcagaaagaagatttgaaaccacacagttggcttcgcatcctgtacgcttgactatttctcttttctgcctctcttgggagaactctgaaatactaaagtactatattactaaataaatgcttgctaaagcatttatttggtcccatattctcaatttacacaattcttttctccaatcacatttcattttagactttatgagccctgttgaagtcatcagcttaaaagtgcccttgagcaattctctactctagattgagttaaacagagtatctgtagataatctagaatcacagacaatacctgtcttagttcctttgggtcgttataacaaaaataccatagtctaaatttataaacaacggaagtttattttgtacagttctagaggccgagaagttaaagatcaagagaccatcaggttcagtgtctggtaagggcccactctggttcacagatggtgccttctcgctgtgtcttcacatggcagaaggggcaaacaagctccctgggctccttttttaagggcactaatcccattcaccagggctccaccctcatgacctaatcaccttctaaatgccccatctccaaataccatcatcttgtgggttaggatttcaacttatgaatttaaagagggacataaacattcagaccacagcaacatctaattttgagccacctaactttgaaagaacaaggattgattaatccaatgtcagcatacagtataccattagatgtgagcccctcttggcaaacttgataaaagtgtgagaaaaaaattacctagaagactaataaatacagaatagtcacatataatttctgtttaaagatttataccttaccaatttccccaaaatgatttaacacaactcattaaatatttgtaaaataatttaaatcttaaaatatatattgggaaccagttaggaggagagagaaaaagacaccggttcctagaccagcttggttattgtacttggacatttcttaggctctgaattttatggacgctaaggcaaatggatcacaaaggagtaaaagataggggaagggaacaaaagcatttagtgtgctcccactgtgtgcagatcattctgttggccactttcccataccttacgccctttattctcacaacagacccttgaggtagttaccgttattttcatccacatcaaagtatgtggcagaggcaggatttgaaccaagcctatttgactccaaagcctgtatgtatttttttactaggtttaggttttattattcttacccaataaagtgacatatgatttgtctggagatacctagtcttcctttgaggattttttaaaaaatggatccctatgtagagaacattgggtaaaatcatagtaacctatgaaaagtaggtattcaatcaatgtttatggaataacatgagtaaataaatgcatggataataagatgaaggatatcttctttaattttataagctaagtaactgttttttgtaaatgcttctatgttaactattaacctctataaaaaacaaagccatatcttagcttcataattcagtctaaggcagttaggtaaatacttaacaatttaatattttatgtttttttctttcatagtttaatttctcaaaagaatagccgaggccccccttatctttacttcttccacccctatttacttctcaacccactgaaatgtgctccgtgtttcctctgattctgttcaaggtcaataatgaactcattaattctaatccaagggacactttgcattctctgtcttttttggtctctcaggggcatttaacattcttagccacttgttccgtcttcctctttacctctctggctgctcctttgtaatcttctcttttatattcactcatgaagtattgaggattttcatggatctgtcacgggttgtgttctgcttgccttctactctgcacctccctgggtcatctcatccactctcataactccagctgccagcttcatgcagaagactctcaaatctgaaaactgggatcaactattttttatatccaaatactctaaatgaagatctaagccaagactgtctatcttgaaagtaagttatttctgtctatggaggcaaaggctcacgtaggaagtgaagaatcttatatatttctaagccatttcttggcagtcagtcacgtattaggagtcagttctgtgtgtttttaaatacagcattgaacgactcagtgtttgttgttattagtgatttgttggacaggatagagagaaagcacagttatttaaagataaagtgtttgtagcccttctcaattgaatagcatacatacagataagatgtctgtgaaattttaatagaaatcaatgtgaaataagattcaatttataaaatctcaaattacaggcaacttgtcaaagcctagctgttgtgtaaacgtgggaattcacacaaggaaaagatgattgattggttgattgattatataacatgagttacattctatccaattgcacctgaatatattcacagacgcagctggatggctctgatttagagaacaagtattttcttcttttcacacaatctgttcctagaagcgccatcaaaacataaatattattttctcataataatataaggcatagtgattttattcttagccaaggatttagtgttgtagaattagttataattaacaatgtgttagtaaagttgagatagtattttaaacctatctgagtacttaaaataatgtaattttgctccagattctgccaaaaaaaatggaaattatttaacctaggattctaataactaacagtatccatagcattaaaaattacctttacatattgtaaatgtcacctgcctacaaataacatgtccattaaagtaaacattacttaaatatgcagctcaacagggcctggtttctttacaattaactagaaaatttgaactaaatcttcctgaagatttcttctctattaaaaacaaaagctgcctcctttccttgcttcacagctttttggacctgcctgtgatgagtgtcctttattgcccagtgtaattttgccatggtttttagcaatctgcaaacactccagcccaggtaacctgacggtagcatagacaggaaaggaggggatgtgaatttctgcctctctgcctctagtggggctgctaaggtaccagccatctaaacatctgcccaggtcttggtgcagtccagcttttcagcagagtcaagggcagaaattctgcccgacttctgtgtctggtacctatttgtacaatgcagaggtcccatgcaaattgttttcctttgaaataaccttaatgatttcttcaggtttcaactacagtaaataatttgttaaataaaaatattagaatgaaaggggggaaaagaaattacttcctctagcaaatgagactcttaaattcaaatttaattaaccaagacgcccccaaaccacagagcatgtcacccagcgttgacaattaattagctttgctctgaaagagctacaggtacccagcaaagagttacggattaaaggctttactcgctctgcgaaggctgcccatttctagctatcacaccttgatagtggtttgttgcttcaggcaacaaattacatctgaagtgtgtgatttcatgtccgtttttaatttcacacaattgaaatatgggaaaagtgaaaataaagctctacttcttttcaaaataaagctctatttctttcaaaataaagacattaaaagtgaacaacactacttcttttcggtttctcatgctgttcaagataattttctatcaaacggtgaaggaagataaatactaaggaaaactctaaaggaatgagtggtcactcttggcttttaggcgggctctctgtttatggtagaccattcagcttcttccttttagcattaaattagcatatgtataaatgatttaactagaaacttggagctagcatctaaaaggcagcatggtgtaatgaaaagaacattagattccttcgattcttgaaatcagattatctgggatatgcttatcccttgaaggaatcttaattttagttggatagtccttaaactagaaaagatatacgtacatattttatagacaattgcttctcagccgaaaaatcaggcactgacattccatgaggaatggactttaattagccggtgattgtctttctctgtctatatttataggcaaccgaaatagctgggttgtaggtacatggtttcatcaattccatttaataagaccagccagttcactatcattcatgttcatgaaagataggaataacgtcagttaactaaaatcatttatatctggctttgggatggctttttttttttttttttttttttttttgagatggagtctggctatgtcgcccaggctggagcgcagtggcgtgatctcggctcactgcaagctccacctcccgggttcatgccattctcctgcctcagcctcccgagtagctgggactacaggcgcctgcaaccacgcccggctaattttttgtatttttagtagagacggggtttcaccgcattagccaggatggtctcgatctcctgacctcgtgatccacctgcctcggcctccgaaagtgatgggattacagacgtgagccaccgcgcccggcccgggatggctttttaatgcatgtttaaatggatctggtgtcttaggtgtttacagttcttttaatttatgtattaagcccagtttccataattgcatactaggtggaacttaggaaaaggcaagaagctattaagtttccctggtactaagcaggcctgggggtgggcagatcaggccaggaacataaagacctgcagtcagggagcatccgataagaacggattgatggtcaaaaggtcagctggcacagggaaaagtacgtgtgcacctaagtgcagatgaaaaagaaagatccacccacactggcgccgaggcttgcaagtggatgtctggcaagcaagcagaagccgagatgcagatcaggaagctaaaataaagaagctggggcatctgggaagaccgagacccagggctccgcacaggctaaacagcaggaagaagagcgagtagaattggggtataggcgtggccaggtcatcagttacccaggtgcacggcggctgtcaggaggtcaggcagcaggcaaaactctgttcacaggtaggatagtgtgagggatcctgcccgctgtgctttctcaagtagggactttttacctctcattgtccaacgtacttctgcttttctcctccctgatgaagatcttgtgactgtgtactggcaggttggagcccacccctccaggacagcagggagcaaaggaagggtagctttgtaggtgtgggtggagataaatattcatgcatgggcaatgaagcagctctaagctatggaatcacatgtcaacccatatgtcacgtggcatcaaaggcagtttatacattggtaaaatgttcctttgaacttttctattccacaggaattgggaataagttttgggttatttcatcttccagtgtccttaaaaatgtggagcatgctctctcttaaaaatatgaatggttgctgtggcttagagcaagtcgccaccttcccgaggtcatccaactctcagaaacagaacttctctgttttaatgagtgtttttctctagatcttgacctagaacttgttgtctaggcagtatctgggtctgacttactaggtttgctggacagacagaaatagaaaagtgcaatgagacaatcgatatgttcttaggtgcccacagagtgtggcaccaacttgtcaagttctggacaaaattagattcattagtgcagaagtcctcaaccttctcttgggtcctgaagcccagcttttgcagatggcgtcttagtcattagtaaggccgctccatcggagtccccgtcatacaaaatattaaaggaagctgtgaagatcggttgcagtgtctgctatcctgctgtcgtctggccagaggtgagccgagactgtggggcagcggggtactgagcagctgctgtataatgagccgagaggggttaacccctggcaaggcaagcagaagagtcattcttaacatgcttagaatcccaatattcattgcagcagcttcaccaaccctgaaaaaccacagcatcagatggtttcttagtaaatacacttatcagaaacagaggcagagggtgcttccctttgaacttctgagacaaaagcccccagcaaggcatggattctgccaccgacggagtatttatttggtctttctaaaatccagatctctgcagccaggaaataacaaactcttgctttgtacttctgtttagccttccatgccaatgactatttttttaattaaatattttctgctttatttttgtgtacaaaagtgtctattttcacacagggaacttggctcagcaaacattcgtagttacttggctttaaacaaaggagaaggttttacattgaatagcttttatttaaaaattggtttatactatcgaaaggaaacattgaggaaaccccccagggcatttggactgggcacagatttcttgaggaacaccccacaagcacaggtaaccaaagcaaaaacggacaaatgggatcacatcaggttaaaaagctgccgcacagcacaggaaacaatcaacaaggtgaagagacaacccacagaatgggagaaaatatttgcaaactatccatctgacaagggattaatacccagaatatataaggagctcaaacaactctatggaaaaaaaaatctaataatccaatttaaaaatgggcaaaagatctgaatagacatttctcgaaagaagacatacaagtggcagacaggtacatgaaaaggtgctcaacatcattcattgatcatcatagaaatgcaaatcaaaactacaatgagattatcatctcaccacagttaaaatggcttttatccaaaaatcaggcaataacaaatgctggtgaggatgtggagaaaagggaaccctcatacactgtggatgggaatgtaaattagtacaaccactgtagagaacagtttggagcttcctcaaaaaactaacaattgaactaccacgcaatctagcaatggtagtactgggtatttatccaaaggataggaggtcagtatatcaaagagatagccaagctcccatgtttattgcagcactattcacaatagtcaagagttggaagcaatctaagcatccatcaatagacaaatgaataaagaaaaggtggtacatatacagaatggagtactcttcagccataaagaagaatgagatcctgccatttgcaacaacatggatggaactggaggtcattatgttaagtgaaattagcgaggcccagaaaaacagacttcacatgtttttatgtgtgctgcccagatgacacaattcaggaaaatctttcagctcctaccagagagtaaagctcttcagctgtagtgggtttacctgctgtgtgtcttcaggcttctcccagttctttatctctgctgtggagccaatataaagttatcaataacatttggtggtgtagatgcttctcatctgtgcaatttaggagtagactctaatacagagcagctgctgggtgaaccaaagatggctttagtgatatttatagcttattgattgcatagttctttgtctgtgattatcattcaataaatactgatggactgagtttcccggaacactgagattcgttttaagcagcttccagcattctttctgtgtatgtggggggaggttcaggaggcagtagaaggtggccataataatgttgtcttgtggtggtagtagttgttataatttcccttttatatcctaattctggccacgacctaactcactgtactgagacattttccccctataatatggagatatgttgctaagcaaccagatcagtaattggtaagtgcttatgtataatatgatttgatttgagttacatacaaaaatatgtaaatggttttttatcttcattattagataaatgattatcatttggttttattttgcccaaataaaataactgctttcatttaccaaaattaacatgatgtagtagaaaggccttggatttagaggatggaaacacgaatgcaagtcccaggtctgagagtcagcagccctgtggccatggctaaagtcagggaacttgccaggcctcgttcttttttttcaacccgtaatgtgtggtacaaataccttctctgctggcctcccagggccaggttaaggatggatgtgatgatgtatagaaaatgttttaagaaaaaaaaaatccaaggtctaagcattgtctagaattccaggctacttaatcttggaactctgagtctgttagtataattccaaaggctggattgactaagaagtactgtcctccagcagggcacagagccatagggcaggtctgcgcctatagaagaaagtaaacacatggcatggaccctgaataagtgaacagtgcagtgatggtggcgaggcagaagcaaaaggccacatggtcaagcaccctgtcattaagcattaaaacataagatagatcatctcaagaccaactgctggccaggtgcagtggctcacacctgttattcctgcactttgggaggctgagatgagaggatcactcgaggcgaggagttcaagaccatcctgggcaacaaagtgagtccctgtctctacacaaaaaacctttttcaattagccaggcatgatggggcacacctgtagtcctcgctactctctaggatcacttcagcccagaagtttgaggctgcagtgggctatgatcatgccacagcactccagcatggtgacagagccagaccctgtccttaagaaaaaaacaaagcaaacaacaaaaagacaactgctataagacttcaaggggaaggacaatgatccacgggggctgaagtcactgatgagggcaacttctacaagtccttgaagcataggaaaattcttttttcttttcttttcttttcttttcttttctttttttttttttttgagacagagtcttgctctgtcgcccaggctggagtgcagtggcgcgatctcggctcactgcaagctctgcctcccgggttcacgccattctcctgcctcagcctcccgagtagctgggactacaggcgcccgccaccatgcccagctaattttttgtatttttggtagagacggggtttcatcgtgttagccaggatggtctcgatctcccgacctcgtgatccgcctgcctcggcctcccaaagtgctgggattacaggcgtgaggggaaatttttaagggtaaattcacagcgatgatttccattggttaactctgtgcattaacatgcaaatgtcaatccatttccaaatgataacagtgcctggctgtagtattttaacatgatattgtttgaggctaatggccaccatgtttgcctcctagcagtaaacatgttatttgaagtcatgtcatgaattaccttcctgcactaatgaaatagataatttacataaaaatcaggaaaaaaaaaaccccagccccatatgcttttcaatctctagagccatggaaatgacctccctgacagccaattagaaaatacaaaggtgaaggtggatgctcttattcccgatacggagaagttccagaatgactagcgtgcttcttggctatgcccaaatacttttaagtaggtgttatttcataataaagcattaatggtgtttgttacatgtggatgaatatcttcactgtgtctgggagctctgcctcagaacgtaggatcttgttccctatccctgctgtttataatctgttttattaccttctcccactgtgtcatggaccggatggtttttctaggggctgctgtgatctgtcttgtcattgcttattatcagatagccttaatcctcagaacattgaaatagttctataatggcacgtgagccatggcagcccacagcagcactggccattttcacatgaaatggcagcctggattgtcctttacatgctgacaggggagactgtccatctgccacccctgtcctgggtcgggaccctttctgttcagcaggtgcagtggctctgagagtctcacagtttttcagttgatatctcacccatcaattacctgggttggatttgtagagctcgaatgacctcttaaattttataaacactttacccacctatttgagcatcccacacttgagcacccctcagacaagatgaaatattcttaggatagggttaggaacacacagtattcctgaaacttttaaagatatagaggtccttaaaaattaccatattgcctgattttcctgtctgtgccccaaggaaagttctattcttcatgaagctaataatttttaaaagattgctaggtcaatattttagtaatctttagacactaaggataggagatttcaatttaattctcatgagatgcacttagaatgacgggttttccatttgaacaccctgcagttctcacaatccagggtaatagtctgacaaatagtctattatacaattacaaaaaaaaaaaagtcaaaatcaagttccccctctaatctacataattgagacctaagactttccctgcacttaaagccattgaatccaccagatgagtgtggacctcatttttttaggtttgggtagatctggccaatgagagcaagtaaccatcctatgtgaagttcatttcagttctaaactgatccttgaattcagatattgtcatattgatgcattaggagaattgtcttgggtgtgagatgagtgaggctatggagagaaaggactggcactcagagggaagactgagcttactgggacattctagccaaggacaggctactgctcttctcctcactgcctgataatgctcagtgtggcaccactttttttttttttatttctgagacagagtctcgtgctgtcccccaggctggtgtgcagtggcgtgatcttggctcactgcaacctctgcctcccaggttcaagcaattctcctgcctcaacctcctaaatagctaggattacaggtgtgcgccaccatgcccagctaatttttgtattttcaatagagatggggtttcaccatgttagccaggctggtcttgaactcctgacctcgtgatctgcctgcctcggcctcccagagtgctgggattacaggtgtgagccatcgcacctggcccactttttgtttttttataggtgttcaggaaatattaatttcatcctgctagagagactttttccttgaaataaggcacagataattatatgaagctaatggatgtttaaagatgtatgctgggataaatagctttaggaaatatattgtactatccttggtaagaataagacaagtagtttttaagttatggtagtttttaagttaatttttctgctactggaaatcttataaaacaacccattcattttttcctatgaaagaaagaacttatcaggcattaattacataaaatatacttctaatcaaaatgtctttaccttttcttttttttttttttgagatggagtgttgctctgtcacccaggctggagtgcagcagcacgatctcggctcactgcaacctctacctcccaggttcaagcgattctcccacctcagccacccgagtagctggcattacaggcatgtgccaccatgctcgactagtttttggattttagctgagatgggggtctcaccatgttggtcaggctggtctcgatctcctgaccttaagtgatccacccacctcggcctcccaaagtgctgggattacaggcgtgagccactgcacctggccgtctttaccttttcaattctctcatgactgcctctcctttatgtccctaaataatacaattatacgtgaatgatttctcaaccttaaccttctcttctctgtgtcattgaagtgctatatgaaaagaactgaagctgctgacctctaagacattggaatatataaaaaaagatcaaacagctgcttataatgatgtcaaagataaaatgctattatagaatctatggctgtaaaaatgtgatttatattaatttttagtattctgaaaatttcctgatatatttattttatacacacattttaagaaaataattttatatgcattctcaagatgacttcctctatcactgtttttctgcattgaagccaacggaggctttcctaaatggagtagagtccaggagtcattgcagaatctctatactggaaatcattctggttccccactgcacgcatccctctccctcgtattcctggtaagcagttttctacccaccatttggatattttcagtgacaaaacacactcactattttatgaagccaacacatcactagtgggttattccaattttgagagaaatgtcgcttatacttatcaagctaaagatgcttttatgtttcacctgctgctttggtacctgtattacataggtttaacccctattcagatacaatacggtacaatacaggacacataggcctagattcagccttggctctactacttattatttattatattctttcaaaggatcattgattagtgtactaaatgctttacatgtactgtcattaaattctcataaaaagtctaaaaaagtaggtattatttttgcttcatcttcctatgtggaaactgaggcttgataataatatttataatagtgatgatgatgatgatagcattgtcatgtgccaactgtgttccaggcactgtgcttgggcctttataaacattatcagaatttaggtaacttccctaagattatctacctagcatctaggaagctggatgttcaaactaagtcagaaaggcctcaggatttaactgccttgagcttcacttgtttgtctgttaaatgggggtaatattgttctcctcacgagggcttctgagattcaaaaaaatggcttatgaaagtatctggcatccttgcttgaaagatacttccacatgtcatttattcatttctttaaagagagctttcttgaaagactctttccttcctctttctccaggtttcttttctccaggctaaatatccccagctcctgtagtcttcgttcattcattcaaaacataccgtgagctctcttccctggtaaaatttacattctagaggggaaacagacagtaaagcaataaacatggtaaccaagtaaagcatctgctatgttacaagataataggtgtcatggttgtgaacaaccaagataatggaaattaggagtctgggagtgagtggtgttttattgactgtggctgtgtgacaaattacccccaaaacttagtggctaaaagcagcaatgatcatttatcatctctcgaggtttctgggggtctaaaattcagataagacttagtgggtgtgatttatctctgttccatgatgtctgggacctcaggcagaagacttgaaggatggcatctggaatcctctaaaggctcattccttcatatgtctggcagttgatactggctgtcttctggggtcctcagttcttttccacttgaccctctccatgtgacctgggcttcctcacagcatggaagctgcgttcccacggtgagtgtctcaagaaaggaagccagggagaggccattattgccttttgtatccaaagctcagaagctctacagcatcacttccattacattctgttggccagggcaatttcagagttttgcttgggttcaagaaggaacatagacgcccacctctcaaggggagagtatcagtgtcaggttgtaagaagtgcctgtgggagacacatggatgcagccatctttggaaaggactgtctgccatgatgggcaaggtaggttcacggataaggtaacatttgagcgaagatttaaaggagatgagggagtgagccatatgcccatctccatctcggcagagcattccaggctgactcaagagcctgtgcaaaggccctgagatggggattggaccaagaatatttggaggctaggatgactggagcagaatcatcaaagaagagagtagtaggaaaagtggtctgagggatatggggggaagggacagaccacgtaggctttataggccactgcaagtactttggcttttactctgagtgatatggagagccaaagggagggccttgagcagacttaaatcttaaaagagttactctggctcctttgtgaataggcaggtggagagcgagtacagaagatggcagacaagttaggagactgtggcagcaattcagcaagagaagtctgtggctctgaccaagatggtagtaaaggtggtgagaggtgatgggatcacagatctactttgaagttttagccaacaaaacttcctgatggattatgtgtgagaagaagacaggtcagcatcgaagaagtcattggaaggatggaattgccattttctgatacaggaaatgctgaatgtgtaacagctttgcaggaaaaacatcaggacttcagttttagggttggcaagcttgagatgtttattagatatccaagtggaattgttgaagaggtaattagatacataaataaggatttccagagagggatctaagctggaaataaaaattgattaatcataggcattaaggatgttatttaaatcatgatcctggaagaaaacaccaagggattgagtgaagcagtaaagaggacaaggactgagccctgaggcctccatcgttaagaagctgggcagaagagaaggaaccagcaaaggaaactggaaaggaatggccagggtgtcctagaaaccgagcagaaagggtatcaaggaggaaggacctactcactgctctgagaggtcaagatggggctgagaaccattaacttgagcaatcatggtggtcattgggaacccagacaagagcagtttcagatgagtcatgggacacatgcctgaatggaatgagcttatagataatggaaggagagggcctgcagaaggccagcacagacaacactttccctgagttttgcggccaagatgggcaaggaagtagaacagtagctggctggggaagaatcaggagaaggatttgtgttttatgttttaagatgagagaaataacaacatgtctatgtgctgttgggaatgatctagtagcgtgaaagtttgtaggagggagagggaggagggaaaccttggagggatatcctggggtgtgctttactttcagggatcctcgcttttctcctcagcaggggatgtgtggggtgggcctgggtggcagagataagaaaaaggaaaaagccatgaggctactgcccgttctaagctgcctttcagtatcactcccttcccctgtctgtctctccatgtggactgggaaccccagcaggtaggggagtgggaaccatagccattgcctggtcctttttacactgtgaaaaggaaccttgaatgtagatggataaacaccatcttttagttcctggcagatcactgtcttccttcttgttctagtcctctgagacataggcaggctggcttgagagcagggagggatcgctgagcagaggtgtgtgcgggtgttagaaggtgccatgatgccttgtgccaatgactgacctgggatgagtcactgttcatttagggagagaatttcaaaaggaatgactggtcattgaataattccatttcacccttgattttagaaggaaagtgccaggaagggtagcaatgagatgaaaaaaaaagtattcctaggtttttcttttcactgattgaaaagaaagtgtcccgtgccttccctttctcatcatcctacaatagggtgacttagggtatcttcccatcaaaatcagtaattcctcacatatctcttccccctgtatttcactcttgtgaaacagattttcagttttacagatgagaacaattaagctttgaaatggtaacaccatttgctatatttgtgcagtggcaattttttagctcagaatttatcaaaagcatgacacttaatgatacagaattaaaaccagctatcccagaccattgaaggagaccggggtcggggagggagaggcggtgcaaacggtgttgcttttgtctttctgacctgcttctctcgtgatgtgttctgcaactggtaagaacattggatgaattataagattttaatcagtagaataaagtcagggcggtcctttcattttaagcagcagctcaaacatttgatgaggaaattagaatccttagaataagagtttagtgtgtaaacatcaagaattcatccagaaatgagtatattagagtctgtgaaatgccttcgcctcacactgccccttcccctgttttcttcttcttttctgtgataagatgatcatggatttgttttgtttttcttttgagacggagtctcactctgtcacccagcctggagagcagtggcgctatctgggctcactgcaacctccgcctcctgggttcaagcgatcctcctgcctcagcctcccgaatagctgggattacaggcatgcaccaccacacccggctaatttttgtatttttagtagagatggggtttctccatgttggccaggctggtctcgaactcctgacctcaggtgagctgcctgcctcggcctcccaaagtgctgggattacaggtgtgagccaccgtgcctggccaagattatcatgttttaagtgttacaggacacttgaatgatggacgatgtcattggaacagcctatgttattaatgatgccggcagcctcccctcccacctttccctgccttcacactctgtgcccccttcagtgctttgaccccttactcctcgcacttgaccatgaattgcattttgtatttaaagacctccctgcacaatatcctcttatctacgtaagcagcccatagcctcagcgccctgcaccctggttggagttcaccttctgatttggtggtatatttctaaaaccagtttgatttttcctgttgcactggggcttgtgtttttcttccagtgccctgtacatagcatgccttgactggtctccacatcgttcttcatcagactggtttggattttacaaggtgttagagtttttaaattagctcatgaggtctctcgcacctgagtttatgccagagaagttgtggagtgatgaacttaatgggtgcccttatccccaaagatgcccagctttgttcctgcttaagctgaatgttggtggataacacatcattctttgtaaatcgtgattgcagaatcctgctattttatggctttgtttttccttttgtcgtataaatgattgggtagctcgttaacttcactctgttatagtaagggactgctacagaggacactgagcaggaggagagaaggaatgattaggcctcagaaagaacgaggggttgtttaagagaaaacgaagtaagcctagcagatctgatcgtacaatcattttccccttattgttcctttttccactccagagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtaggaccatccgccgtccctgccatttgcccagtgtgcgaggttctggatcaagtttcaggaggaagaaaatgaggcctccaatgtattaaaataagacgttgccagggagaaaaggaggcaagatgaaattcatttgaaagtcctgaaaattgtcatggttgcatacactaagtggtaaactaagaccttcagattgtaagagatctgatttgcttttggtgggaaaaatcagctttgcattgtttgacagaatcgtagccatttaaagaaaagacacaaaggcacaaaatatcgaggcaggggcaggagaccgagggaggccacagcacaaggtacagaaatgagacgtaatgaggcctcataatttccctgtgacactttcgagtttttgcctcctcttcagagaaatcctgacttctgctttgaagcagcccactgaggggattgtgaggaacgctgcagtcttgcctttctagccaacaagtgcgatttcgaattgttacaaatgctcaggaagagatgtaggatcgtgcttacaagctgttgctcagctacacttgggatcactttatttttaaatgtcatttctaaattctttctcccttccgaggaaagcgtttgggtgaagtaacttacggtttactcatcattggtgaataagccagggctcatacaaacatgtagtgaaagaaagacgtggcggtttaattttttatttttatcaaaagtaggagtggtgcacacgacctcactggtcctttacagacttatcgtgactccggccctgggcttcatttggccgccgttgctagtcttgctgaagctccggagcaactactaaactgtggggatttagattttacttgttcagttcgcagactgccagtcccctgggtacccaaacacggtcatggctgggtttctgggcctcagaaggcctctgtctctctggagtctccccttgcaccctctaccctctcttcttttcacctttcccagtttctcccgtgtccttccatgctctcccaccctcaatctcaccacctcgttgggaaggtattaacttcatgtggtacttttcccaagaagagtttaaattttaagattacatggaataggtcaggcactgtggctcacacctgtaatcccagagctttgggaggccacagcaagagaagcacttgaggctaggagttcaagaccagcctgggtaacatagcaagaccctgtctctacaaaaaatttaaaagtcagctgggcacagtggcagatgcctgtagtcccagctactcaggaggctaaggagggaggatcacttgagcccaggagttagaggctgcagtgagcaatgatcgtgccactgcactctagcctgggccacagagtgtctctattttttgaaaacttacattgaacagagcagtgcctcctctgaggggaagcatccagtcctggagctttccttggtggtgggcagggcagacagttttcagctgagggctttcccaggcccagcagcaaagtaagacccaaggaggcagggaagtggcctgggctgtctacagggcctgccccagcatcactggacatggaagcaggtggaaaaaacagtgtggaccaggactcctgtccaggagaggactcagtgggtgggagcccccgaggaggggccgtggtacgccacaggggcacacgggtgtgatcgtggatggttgattcgctgccttctaaggagggtgggtccaagtaactgctgggatcttctattcttttttacattttttatttttaattgtggtaagatacaggtaacataaaatgtaccatctgaactgcttttaagtgtacatgggctcttgttttgcaaagagggatttggaacttcagtgccggagctgaactgctctggacacagtgaaatcaagctgtcagtgcagtgaccttcccctcctgtactctaagccagttctcttctgaataagtgtgagcaaatgtttaagtggtatctccttgaaaaggtgccagatgatcagccagcctggggtgctcatgtaccccaataccgccctgtccagggcacctcaaaatgaagcacatcagaaaccgtcctcctgcacctacagtactggccttgtctgtggttcctacaagggttgatgtggatgcatcttcaggtggctccgacctctccccctctatccctaatgacctccctggaattctgagacaaggacatcagggtgccaaggccagggaccaaaacagcagaaagagtgtcccagccagcaggatgacccagcactgacacaaaaatagtttagagggcaaaggacactggtccaatcttgatttcatgatgtaccatatgtagtgaccacagataaggggccttacaatgaggagttatgcttgttagtaaactaaagtttgcatttcacacttttttaaaaaaattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcaggcttctggggcatgggtaacagtgagggggaggaagtgacagttggagagaatgtgtaccatgattggaacaagaagttggctgggcgcggtggctcacgcctgtaatccaagcactttgggaggccgaggcgggcggatcacgaggtcaggggttcgagaccagcctgaccaacatggtgaaaccccgtctctactaaaaatacaaaaattagccaagcttggcggcacgtacctgtaatcccagctactcaggaggctgaggcaggagaatcgcttgaacctgggaggcagaggttgcagtgagcagagatcgcgccactgtactccagccttgacgacagagcgagactccatctcaataaaaaagaaaaagaaaaagaaaaacgagaagttgccaagaccctgcctcttcctgcacagagcatctggttcttccatttcagcaggctcttactctgccctaccatatggtgccaaactgcctgacctcagcgaaggcccatcctcccagactcctgctctctccacctccacggatatctcaccatcattaggaacagcagttctttatacccatgtggaaaaatttccatcaatttatctgttgcataatttatattttaatatcaccaagaaatacagtggagtttaatatagaacataaataattggcgctatatataaatcggcaggtttgaggtagacaagtttgatggaattcccaaaagcaagttgattgattatttaaacctgacctggagtctcctagagtggaggaggggagcaggaatctccaacgcttgagatggccctgaaggtgagagtgttgtcacccagccggaccactgcccctcagcctcagccacccaccacctccctctggaaacctgggaggccttcctccataggaacagatttcatgggtttatgtagagcaacttcttatttagtagacaagaaaactgaggcccagtgaaggtaacaggttttccagtgactccagaagcagggcaagaagtcaggacctttcggccattttatttcctactgtatcactggctgtcactagataaacatgacccttgacaatttggggtggagacaagagtgtcatggaactgcagtggtagcaaaataacgttgggaaccaattgcctttgtccagtggggaaagacatacttttcagagtcaggattgggagaggaaggggaataacagccaagaatagatacacagaatgagggagaagggaggcgtgctatcccatcccttccctccttcccactccctgctgtttccagcaacaatcccactccccagccaccaccagggagtcatttctggccactgagcacctcttgaggcaaaagcttttctggaggccatggtgatggaagaaatggaggtaatttccatgtacttggagttgaggcatgcacacgcacatgcgcgcacacacacaaaccatctcaggatcctctgcccctagagcatttcctgatacacagcaatttttttttttttttttgagacagagtctcactctgtcccccaggctggagtacagtggtacaatcttggctcactgcaacctccacctccggggttcaagtgattctcttgcctcagcctcccaagtagctgggattacaggcatgcgccaccacacccagttaatttttgtatttttagtagagacggggtttctccatcttggcgaggctggtctcaaactcctgacctccagtgatctgcccacctcggcctcccaaagtgctaggattacaggcatgagccaccatgcccagcccacagcaaatatttattaagcacctactaggtgttaggtactgtgctgagcggtaggcttaggtttgaaataatggacaaggcagagcacctgtccttaaggtacttataacttagtgctttattccagtcagtcttagaaagctcaccaatttgggccaatatgaaggacaatctgatttaaggaaaaatcaggattgtaggcttaaaatgattctgtctcactttgaagttacataaacaaattatgctactaagtagtcttatagagatattcttaataagcagataaagatgattagtggatcaaagcagcttagtccccattcatatttcactgatttggcttatatgtaaatgatgattctaatctgtttgaaaacggttgcttctcctaagtcagttcttcatgaaatttgtttgcacaattaattaacatccatgtttaaggttcatttgttagtatgtcacagcttaatgtcagagctttctgtcttggattagaagcttccagagcaaagcatgttatctgtttgacttgctaagtatatggctctgcagccacaccatggtgcatcaacatttttaaaagtgagaatggtaatggtgacagtcatattggattgatgacaatcaaccttttacccttttagggtagaagtcattcagttactaactccttgtgacactgtatggaagagaaagacaagatttctgttcagtttacattcttcttagaggaagaggagaacaagatttttaaaattagattaaaatactgtggttttttgtttgtttggttttggttttgttttttttgttttttgttttttgagtcagagtttcactcttgttgcccaggctggagtgcaatggcacgatcttggctcactgcaacctccacctcctgggctcaagtgattctcctgcctcagcctccctaaaatactgtttttaaaaaaggtactcggtagctgttattcactcagtcaacaagtagaaacagtggggatagctctctgttgttcaggaggtgatgccggggaaaatctcatgcctttcagcccaccaaggtgcagtttatttacacacagattgtccaattcctcattattattgctgtccttcctcatcctgaagcatgaccaaagagaaaagctctgagccagaattaacatctttacttcaagtattcataaagaattcaaatgtgatggacaattctggatcccactggatcccagtagattctggatcccgctagatcccactacactcacaacttcattcttaaacactaaagttgggaaaagcaaattgtgagttctcttttattttggttcactgttggagggggcgggaacggcataaataatacctattcatcactatagctagcctgatagctttgtaaattaaattgttagctcttctgggaaattaactcatgtgacgttaaactccatagttaagcttacgtagagttgggggtggtggttgttttccctttcttcctttatttcttattttgagccttccttcaaccgatacctccagagaaaggcgacttggggaaaatgttctgactcttaatcttcgcggtttcttttttcccacggatgtagatttcgccagcctctggacagcacatgcgcagtatgctgctagcgccgccccaggcgcccggagctcaggaagcgcaggtggcgctgccagaagggccatgctatttctggggcaaacctgaaagacctcagacacaggggctttcttctatgccatgccactgttgaacttagcactccccgttcttgcaaagagtgggaactgttaggagaatattctccgttagaggttactgggcaggaaagtcatcccaaggacgtgtataaagaaagtgtgagccaggcatggtggctcacgtctgtaatcccagcactttgggagattgaggcgggtggatcacttgaggtcagaagttcgagaccagcctggccaagatggtgaaaaccctgcctctactaaaaatacaaaaattagccaggcatggtggcaggcacctgtaatcccagctactcaggaggctgaggcaggaggatcacttgaacccgggaggcggagttgcagtaagccaagatcgccaccactgcactccaggctgggcgacagagcgagactccatctcaaaaaaaaaaaaaaaaaaaaagtgtgaagccattttcattcattattaatatgatcacctttaattctgctgatgagggtgtgtggatatcattttctgttgtcttcattatcaaatggagaactagaaggggtaagcagcacattttggtttaattagatcagatttatgataggatggcatatcgctacatataaaatactcattttctggcgttcctggccagagatgtctacacagagcaaaatggatgaaaggacccacagtgagcagggaggactggtttggtcctgtagcccagagtctcctatcttatataccaggtctgttcttgagctttcagagtgcaagtagagaaacagaatttagcatccactttctccgtggagatcctgcatttcctacttctctgaacttcccctgcctgcttcatatgagtagacaggctcttctgaacacatttttgtttaagtttcagggacctgacgccttccaggcactgatatgtgtacatatactccacaagacgtatctatgggcaagctagaattcagccccttatgtttctagtggaatgttcatttcagtttccgtcactaggttgttagcttcttgggaggaggaaacatgttcttttcatctttgtaccctttcagtgccagctcagtgctagaaaggatacacaatgtggttgaacttaaaaaaaaaaattctatacagtccgtgtgaagtcttgatggggcgctgagcactgtgtagggtccgtcctgaaagaggcagctgcaaaaatgaggcagaaacagtgaaaacatggacgtgaccagaacccagtggtccttggctccacctgctcttcccagggtgcgagttgtcccagggttttacatcaggaagaaggtgacgcttcatgccacacgctggcaaagaggaaacagtgtccacattcctcactgaggaattttctcgaagaccttcttgtcctgtcctctcattttgcatgtaaggaaactgagggccagcaagaggcactaacttgtcatcccactttgtgggagaagacaaaagtttaaacttctgaatgtaaaagatgatttgttgtggaaaactgttaatcagaatttgaataagagattcgtaatcttttcctcccattttgcaacttttttttttttttaaaaacagggtttcactcttgttgcccaggctagagtgcaatggcacaatctcagctcactgcaacctccgcctcccggtttcaagcaattctcctgcctcagcctcccgagtagctgagattacaggcacccgccaccatgcctggctaactttttgtatttttagtagaggtggggtttcaccatgttggccaggctggtcaactcctgacgtcaggtgatccacccgccttggcttcccaaagtgcttggattacaggtgtgagtcacagcgccctgccccattttgcaacttttgatctcaattctgctggctctattttaaggtattaaatggagatggtaggcttgtgtatgtgtgtgcacgtgtgtgtgtgtaagtgtgtaggaggaggagaagaaagataatttttataaggggactttttaaaagctagcaacctttatcataattggtggacagccttggggcctcctggaatacctgtaattcctaattagcatcctgatttatggaataaaaacatgagataaaatgagggaattctctctggaataaatgccactgtctcaattaaccaaagggcaataagatggattataatgccagaatagggcttttgatcagtctttgtccaaaaaccacattttagttaagctcagcacaattagaccattactgatatcaggagaatggaaacagtaggtatattttaagctaacattcccagcatcttatctttctatagtctttctcttgttaatggatgaaaggaaagttaagcatgatttgttataattatcccattaaaatgggatcgatagaaatattttatgttaaaaaaatggtgagtccaaactgctgagttaattagaaagttttcctttgtgcctcaaacagaataggaaatgctgttcttgcctactgaattgttcgtatcaaatagaaaatatttgaatccctttctaatgcctcattgaaccaaaatgtattattatggagggggagaataattccgatacattctttttttttttgagacagaatcttgctctgtcgcccaggctggaatgcaatggcacgatcttggctcactgcaaactctgcttcccagattcaagcgattctcctgcctcagcctcccaagtagctgggattacaggcatatgccaccacgctcagctaattttgttttttagtagagagggggtttcaccatgttggccaggctggtcttgaactcctgacctcaggtgatccgcccgcctcggcttctcaaagtgctgggattacaggaaaaacaaccaaaaatagaacaattacagtagcaccgagtgctagagacaaatttcctgccaaatctcttttccagttccctcagtctgcgtctgtgttctgtgccacaaccaaagattcagatatcaattttgtccacttgtagctcatttgagatctgttaagcaacaacagtgaatgctgggtggattcgttagtggagctctgttccagctgtagctaataaagttattttctcgctgaaatcggtgatggtaaaattggtctgttttccaatgctagcttcttcagtttccgctgagttcttttctcctggagtgtgagatcacaatggcatgccttacaaaagagtgctcttgcctgctccgtcctggctgctcccaggccgaccctggctcctcaccagcaccctgctgtaaacgctcagctgccccttcccctagcagcagcgtcggcactacatttaggaccctttctgtatgtaccctgaaaacccaccggcgcagtggttaggctggagcagctcaggccagcctggggcaaaaggcagaggactgagaccatgcagtgagattggtgcagtcagtattggtggaggagctgctgggggccaggcacatgctggaaaagtggcgtgttatgtcccggggtctgaagcaagaatgggatcaggcagtgtggaaccaatttgtaaactcctcactcactgactgtcattagtaactaagttgctacaagctctttttttgtgagcctcaaaacaggaagcccagaagagtttacaacaatggaaactctcaggtttctacaggaaaaaggagaatgttgttttccccaaaggttatttccttctgcagcctggccatgtgcccctttccctcaagtttgggaagcaggacaaagggccctggggaatgccttagcccatgatgagctgagggacagtcatttttgtcccgtcatcatgcatttgatttgctccttgttttatgtaaatatataattttagacagcgtcttccttcgtcagccaggctggagtgcagtggccctgacacggttcactgcagcctcaacttcctgagctcaggggatcctcccacctcagcctctcaggtagctgggaccacattagccaccatgccctgctaattttttgtattttttgtagagacaggatttctccatgttggccaggctggtctcaaacacttgggctcaagcgatccacccgccttgacctcccaaagtgttgggattacaaacatgagccactgcgcatggcctgttttaaacattttaagaaaatattttatcatatttgcacaagaagattttcagtgaaggacaatgttttgaaaatccaatcagtaagatactcgctgggaggtatttttatagaaatccatggaaagctaatcataggaaatcggaaaaacagagagcagggtttgtagcttggcctttcccctaccttgttccgcattctataaaaagtgaaaaagtagcaaagtagcaccctacagggggctcagaggtgctggaggactaataacgcaccatttgcatgtccacgccacgcgaccctgcagtcacgctctgttacaagtacagatggtgaaagtgtggccaggaatggatgccggaagcccagaaggaagttggctcttgtctggaggctcccagggtggatctgcacagccttcccttggctgattcctgtccatcctgtggatatcagtgaaatgccaattccttggggaggctttccctgccaacctccccaaccccaggttatccaggctgggtgccccctcgtgtgcttccgtaaccccccaaagtttctcctcattgcattcatcactctttagatgactgatctgcgtaattccatgttcagtgggtctccttaacgaatgtaagctccatgagggcagggccatgtccttcttgttcccctttgaatccagagcactacacggtgcccaactgtcataggtgtcataggtgctcagtaaatactaggtgtattagccagagttctccagagaaacagaaccagcagggtgtgtgtgtgtgtgtgtgtgtgtgtgtgtgtgtgtgtgtgtgtgtgtggagtgggggtgggggattgactgattttcaggactggactcctgtgactgtggaggttggcgggcaggctggagacgcagggaagaggtgcagctggagtccaaaggcgggcagccgacaagcagaattccttcttgctcagggaaagtcagctttggttctattcaggccttcaactggttggatggagcccaccacattatggaaggtcgtctgatttactcaaactcagctgatttaaatgttaatctcatctaaaaaaatacctccacagaaatatgaccaaatatctgaataccggggcccagccaaattgacacattaccatcgcactaggggaatgaatggaatgatgacactggtttccattctgttgcgatgatccttcccatccgtataaggcctgacaatttccatgcccttgcacctatgtcatcttcctggattttttttttttttttgagacagtctcactctgtcgcccaggctggagtgcagtggggcgatcttggctccctgcaacctctgcctgctgggttcaagcgattctcctgcgtagctgggattacaggcacatgccaccactcccggctaatttttgtattttttatggagatggggttttaccacgttggccaggctagtctcaaactcctggcctcaagtgatccacctgccttggcctcccaaagtgttgggattccgggtgtgagccaccgcacacagcctccctggattcttaatacagccctgagaggtaggcagtggggcagtgcggggaggcaggggcttgttagatgctgcccatagatgagaacactgagattcagagagggcaaaataattcctagaggtgacaccgcttttcagagtggatggggtgacaccatatgtttgtttctactgttcttttccaaatcatacaacatatgagccattcatcttgtgccaagcactgttcagaaggctccatcctcatgacacccctgtgggaagcttccaccatcaccactcctcttttacactggaggaagctggaccggatctaaggaatctgcccagcatcacatgcctggtctgtggtggagctggcctatgaacgccaactctggaacctgtcctctggatggctgcatgagactgtctctctataggcaccttatgtggtcattttggtttcagaagaggtacagtaagcaaatgttcctggctggcgtgctgcagctgccttggcggggtggcaggcagggggctgtggcggaggctgaggctggtcgtcctcctctgccgctgacagtcccaagctctcttccctcatcatctcagatagctttgtggttgtcactgtgttgttttatatatgaatattttttatggatttttatatatggattgccgtgtgacttatgtttccctgccctaagcacaccgatgaaagtacattaatactcaaaatgactttgaaaagaccaaaagaaacaaaaaaagtcctaaattccgtgggaggaaaaaccatgatcctttagccctactccggaatagtaagaactgagagccaaagccaaggcggggacagcaccctgggagctgatgggctggttagtcccatcccagattatatggaggcacccgggtgattccatttcattgagaattctgtgtctagagcaccagacagtgaccacagaaatgtttaaacttcagcttttgtttaaagagatgtgctgtgagtatttatcgagccatggtctgtggggacactgctgggagagggagcatttctggaacccatcgtggctttcttccttgtctggcctcggcttttactttccttttttcatggacccctctatctcttgtgtccaaacccacctacttttccaggtctggctaagtgccttcttcctcccatgtcccacccctgtcccctactgagcccccttttctccgtgttttgtatcatgtaccatcccttgcccagatttctctgattaaccattcaccactctgttgctgtcaccgctttatgggtctaggttttctcctccactgagtctttaggctacttgagggtgggaatctttgttcctattgcgttcatatccctgaaaatgcttagccatatgtcagacagacagaactccctgaactgaaaaacacaaagatgtggagaatagcacagtccttatatgactttttccctgcttgtccctatcatttacccatcacctcttagtccatctggtcatccattgattcattcagaagacaggtattacgtatcttctatgtgctagttactttggggatacccagatgagttaaacatggtctctatccttaaggattccagaagttgctatcagaaagagttaaaaatcattcttcaggtagatagctcaaactaaaaatacctgttattatggccatcactccggcttaccatggcagataaggctgaaatttgtcccagataattggcttcctggtgagctttctccctccttctttttcactgagtatacgctaatattcctccagtattcatactgcatggtgaggacagctgacggtatagcagccagggaaggctgcacctgtgtttccattttagcgctttgatgtgctgcatgcggttgccctgcaattagttcatatgcgtgaatcacaatggcatatgtaaaacgtgtgctcatacagacccctctccaaagacctcacgcatcctttgcttctggagagaattcccctgaatgtatgtgatgaggaagttgggcttttcctctctgtgccaggctgaagcgaggggctttgctcaaggtcgtatagaaagtcgtctgcccttccaggccgtgctcttccattggaggcaacacctgggcgttctttgttttgcctttgccgcagagggagaaatgtcatatctttcaaaattccagtgtttcctagtcttctttgagaatgcccctgttaagataggtgagaagcaccaggggtaggcgagattcttggataatgtgtgtcctggaaggtggtgtattctggaatggggatgggaggaggggaaaaggataaagaagggaattcttttcgtttcaagcaatagaaattcaaactgtgatgcctcatggaaccagaccatgagaaggtcatgagcgcctggaactaagatctctcgagtgctccgggacgcttctcgcctcgtctcttacgtgtgcttcttctcacattttggcttaattcttcatttcaggccagctttctctcttacagctgccaccagcagactggacagactcctgtcctctctggccctaaactcaaaacttccaggagggagctcagatgagcgggcggttgggggtcaggaagcggctgctcagatgaagggggtgctggggttggggtgctcaggagcatctgcctgtgtggaagacgctatcctacaagaaggctggaaagacagacaaacgtcaccccctgcattttttgatggtttgtaggaagtgtcagtgagcatttaggagaaaaacccaagaccaggttacacagagcatgtcaggtctcaaatcccgacatgactcctgtcaaacccagtgccagggaggaggggagcccttcacccaatccgtatttaccgagcattgactgggtgcctgtgaaatgaggacttgggggggttcattttgtggaccactgatttcacaatcatttagcagtttccagggggagaaaagtggcctgcgtattcaacagagcttagagaagagactgtgtagggatttgcccagggagtgcagtagggagaggtgcatcaccaagaatatcggagacttctccttagcaggctcatcgtttccaaagagatggagatgcagtcccgagatagcgctccggcttgctggggacactggctccaggtggacagtcttacgtctgcctggcaatgctggctatgctggctatgctatgacctgcttcctctgtgaaacagctgctgaacaaaaatgcccaaattttagcacatcaatctcttcttcttcctcctcctcctcttcttcttcttcttcctccttcttcctccttcctccctcctcctcctcttcttcttcttcctcctccttcctccctcctcctcctccttcttcttcttcctccttcttcctccttcctccctcctcctcctcctccttcttcttcttcctccttcttcttcttccttctttcttctttcttcttctttaagaaagggtctgcttttgtcacccaggctggagtggagtggcgtgaacgaacacagctcactgcaggctcaacctccaaattcaagcgatcctctcaccttaggcccccaagtagctgggactaccagcatgcaccaccacgcctgggtaatttttgtatttttttggtagagatggggttttgccatgttgcccaggctggtctcaaactcctgagttcggatgatttgccggccttggcctcccaaagtgctgggattacaggcatgagccactgcatctggtgtttttgttgttgttgttgttttgagatggaggtctctgtatcatcaagaatggtctcaaactcctgggcttaagtgatcctcccacctcagcctctcaagtagctgagtttacaggtgcaagccaccatccccagccaagcacattaatctttatgaaaatgttttgtttctgcctttccccactcttgcaatggctcaccacagtcatcccattttcccagcagcgtggaactcacagtcagaagggcccattctccaaaattaaccccacctgagagttacattatgtaacacactgggagtgggggacaaggaacatctgtctccatctgtgccaggtgctaacttcctgtgtcgcccaggaacactcacctaacacctccgagtgcctccacaaaagtgccaggccatgtatgtgggacacttgctctgcagtgtaagcaaaaatgggtgcagttttaaaaatattgtagaattctagaactttccaaataagttggataatatcagcagttggtattcatataggttgaccttcacttggcagaacagtctgaacaggtgcgtagattttaagtagacttgaatttgaaggctaaggtcatccagatctctttgcggatgtggagctggaatgaagccctcctggctttgcctcctctgccgtcgtcgcagccggcaggtcccagctctcctctttcaattgctgtgtgaccctacggaagatattcagtttttctgggcctgaacttctttatctgcaaaacaggaaaacgaatcatacttcctcagagggtaattgtgaggctccaataactgtgctggagaaagtggggtatgaggcccggtttggggctgtgggagcacctcttccttctgttggtcctaggagctcagcgcttggtgggatgttccagaccaggagaggctgggactaaaattccagagtgatctatgggtgcagaagcttcagacgcctgttcaagagatgggtatcaggtgaggtgagtccatatttaggtctccagctaggatttaaacctataaggggaagaagcacaggtgagctacagtaattttggctaaaggtccaaactgaggccaatctcagggcatgtccctctaactagaggtaaggcatttagtcaacagccctccaagctcaaataggcagagggtagaactgagggggaatagcagctgttactaggaggctggtcactggcaaccttgggtttcaggagcgagaaatccatcctggatactgcgaacgcccttgattcttagaaaagtagggtcctggcatcaaagctggagcagtatggaacggatgactgcttagacacagggccagtgggtgatcaactacagcctcgtagatttctctttggaggactggagtgactcccaggctcagtaggggactctgtaggggactgagcttggagaagcccacggccaccctgcctccattccaaacaagattattcactccactcctgtttagctggtcacatggctcccccattccttgctctccattgcccttagtccaaagtccaaattccccagcccaaggctgcagggggctggctccctggcctctagttcctgcttctctcgcctgcccccttgactccagtgagtagtttttggtgctgcaaagaggacacactttctctcaccttcgggcctttgacctgcccgggcagggccctccccatcttcctcctttgctctgaattcatccttcttcttcaagctttaatttggatgttatcccttcaccccgcttccccaaggaagttccctcctgcccctgaggcctcttgccatgctgggctctaagtgggcatttatttctctgtgcagagtttgtccttctttgaaccaggtccctcctggacaaggaaggtgctagatacatgtttgtctagccacagggatcagagctcagaaggttgcggggacagggcatcctgcctgccctctctgaatgttcactttgagttacttcagttactctttacctggacaacataacgtcggggaaaactcatttatttgcaaaaggcaaaatacatgacactgtttcactcagaagcccctcagacccagcatctcgccaacctttgggcttaagaagtggtgaaaagatggggagagagtgactgaatgcatttttctgtctaggcaatttagtattacaggagatgctctcaaatccttgaccggagtgaaggcagagttcttgtcagttatgtaagaaaaacagctcattgttatatgatgcacactgaacaccatcgtgtgttttctcagtctttgtgtgtgcggacacgtggcatttaaattaaaatttggccaggcacagtagctcatgtctgtaatcccagcactttaggaggccaaggcagaaggatcgcttgagcccaaagttgagaccagcctgggcaacgtagggagaccccatctctacagaaatttaaaaagtagccagccatggtggcacacacctgtaatcctagctaaggctgagacaggagaatcacttgagcccgggaagtctaagctccggtgagcctgtgattgtaccactgcactccagcttcggccacagagtgagaccctgtctcaaaaatagaatattaattaattaaaatttaaggaattctgtttttactacggtgagtaacaaggttttttttttggtttttgggtttttgtcgagacggagtcttgctctgtcgcccacgttggtgtgcagtggtgcgatctcagctcactgcaacccccacctcccgggttcaagcgattctcctgcctcagccttccaagtagctgggagacaggcgcacgcccccacacctgcctaattttttgtatattttattagaggcagggtttcaccatgttggtcaggctggtcttgaattcctgagctcatgatccacccaccttggccttccaaagtgctgggactacaggcgtgagccaccgtgcccagcctatttttgtttttgtagagatggggggtcttactatgttgcccaggctggttttgaactcctggactcaagtgatcctcccacctcagcctcccaaaatgctgggattacaggcgtgagccaccacacccagcctaacaaggttttttgttttgctcctgtaggtctattttttttttttttccaatcagtattttcaatgttttggctccagacagatttcagtggtgcatcacatgttaccgacgtgcctcccgtgcctccctgtctgttcatctgctgtcgtctctgccagggatgctcgtctctcattcgtttttttggcgtggaaacacgctgctcagtcctcaggcccagctcccgtgtcacctgccacctgcaggccttcctcttgtcccttctccaggcactgtgcctgtgtcccctactccagaccgtgagttgtggatgaaaggggctgtatcttacttgcccctttttgcatttattcatgtggatacatagatgctcattcgcttcaattcattgaacatctgctactggccagggactttttcccttttggaaggagacccagataccctccagacataggtccggcctctcaggagttttcattctcctgagagaggagagagacttgttgagctatgcgtggagtgctgcctgacagcttgctattttctttctttcctgtgagataaaaatgtaccttatggtattactttattttaattctgccatgacatttgtggcggttgttttaagattcagagattactgggtgttgatctccttatgatactctcggttcctaattatgttagaaaaaaaagcaaagcgggaacttggcttttgtgttgccttcacagagtgtggaggttgaaaacatctcagcgcacttcacggaggttctcagagaccccataagtttctggaaaagtgggaaacgcaaacctgtcaacctgtcagtctctcccctctcacggaagcctgacatgtaaatctcaagttgttaaacctgctgtcaaatgagctgcctccactgaagactcccctccgctcctcgcactctcatcactgcccctcactctctgtccccacagcacagggacagcctccgcagactcccgtgtgtgtgctctggagagaaaagattctggatttgggcggtctcacctccaaaattgcagcccctaaggggagccgtgctaaggtgtgatacaggccatgccccttctagccccatgggacacctgactgatagcagcctgtgcagatgtgaggaacagaaggtggccccagaccccttaggagaaaccaaagtgcctcagagacaggacaagtgctaccccggaggccagtcaccaggtgacctgggagctgggaaccttttcagcctatgggtggctgtttatcacgaggggcattagacagacaggaggcagtgctgaaattcaacagcacaaagcaatttccagcttcatcttggcttattaataatgaaacagcaatagcgcaggcacaaatcaacagtaagtaggtgggtgggtgagacaagttggacatttggggaacagcctgggcagctaccgatacagagggaagccatttggtgtgtgtacctcccctcttccctgggataggagcaaacctgaaatgagaacggcagtcatctgcacacaaaaactaggttaggaaactgttttctaaggggccaggttgggtcactctttgtgacaagaaccgtgtgaaccacttcttacctgtaattctgactcagcattgatatttgaaaattcttccctagggctgggtactgagtactgttctgagtgcattacatacaacagctcatttacatacgtaatacattcacatacatcaatcatttgcatgtatcaactcatttatgtacatcaactcatttgcatacctcatttcatttgtacataactcatttgcatataccaactcattaaagttgtctcttttactagtgaggaaactgaggcctagagagtcatgtgcatgctgcatctctgcatgcttcctctgatggtttgatgtgggtcaatcctacgtctgtgcacatcttaacaactatcgtaggtgtagggtgcctttggtttactagaggtttcatcagtccacctgattctcactactgacgtaaatgtcagaggtggtcctgcctcttctcagtctccatcccaaggctctttacagctttctgtggcctgattttcttgctgtggatgctgaagggcactcttcagtggtttctcccagggccgttgcggattgcagctgtttcatacccagatgacctggggggcatcttcagtgtgtgcagatcagactcagcactgatactcgtcctccagccgtactttgtctccgcggtggtgctcagacttaaagcacttctcagctgtgctagtggtcccttcagagaacgaattatgctgaggcagagagggacctggggagggtagggaaggtcacaaattaaacagcagattagaggacagaaattcggtttgtggctttaatattttatactcagtatgacaggcagactcttcaaaaaaacataacctagtggcccaaatcgcaattttacgttatactttcaatataggaggaccctcacattgcttaaaaggggtcttcagggagaaatttacccaaaatttcatgcttggctccgtggtgacggcacatcctcactctgagaaccaggaccggcctcgggagtccaggttctgttcccagtttgtatgcacaccgatttccccactgtctgtcacaaccagtcaacttcccatgtgttaacagttactgaatctacctgtccgcacgtggccaagccccgccccccccttcccccatgctcttctctctgcctggccaactcctcaatcttggcaaagtccttcagaacccttgggtagtgtgagttaccttcctttgtatagaatctgaaaaatcattgccctttttttattagagtcaggatctcattgctctgtcacccaggctggagggcagtggtgcagtcatagcttactgcagcctcaaactccggcaggtctcaagtgatcctcctgcctcagcctcccgagtagctgggactataggcatgcgtcaccatgcctgactaattgtgttattctttgtaagagatgggctctcactgtgttgctgaggctggtctcgaactcctggctttaagggaatcctcctgcctcagcctcccaaagtgatagaattacaagtgtaagccaccacacttgtccatcattgccttttaatctttgcatcctgccacctccccagcacagccagcataggagccggcacttagtacatgtttgtttggggaatgaatgtgaggtcactagtcaatgattctgaaatgagtctattgaaggtggaaaccagcacaattcaaatgctttgcgttaaatgccagtcagtgtctcttcccaaagacccccactgaacccatcagatgtaaaatcccccattttatcaccgaacaacctgtttccacccatttcccttattcactaaacaacccgtttccacccatttctcttgttccttcttattgcagtgggggacgtgtctttgccttctttcaagggttaatgtttccaagtgggttctatcttctcaaggatcactggtctttcgcatataccctcttgctcccgaatcattaagaactcctgcccattggatgatgttgctgtatctccaattatattttgaaactttctccctctcacttactcctccacgtgtcccatttctctgccttcttaatggccacttctcaaacacatggctgacagattccggaggccttcaactcccacctatgaagcagccagtggcctcgggagtggggctgcttgagactgtgggaacgatgttttcgttaagaatggactgcctgtataatggtggtcccataagattataatactgtgtttttactacaccttttctatgtttaggtatgttgtttagatttagaatatgtaacgcaattaccgctgcgttaccagcaatcccaagaggaccccagaccctctgaaggaagcgggctcctgcaggacccgggagacagtgttgaacttgaccttgctctcctcctcgggtcaggcctgccgaccctgcactacaggttcctttttctctccctgtccgtgcatccatctgtttctgcactctcttcggtgcatcctctgaaccaccagaattaggttcctccacaccaaatgtgatcatttcatttcgcagctagattgctcgtgaacagctaagcaggtcacgctgagctcgacacagtccaatcccaagtaccagtcaggctcccaccgtcccttcctatcccaaaatgtcacctcccctgtgttgcagccacactgaagcctcaatgtcccctaaacattccagaccctcttgtgactctgagtctctgcccctgggttcacgccacttagaatgagcttccccccattttctgcgatacacactgtcactttccctgggaacagattcgacctgggcagaatgctcttcagtttgttcctatctctgccgggatctatatgttctggactctcttctacgacacggagacctttcccggagcaggaacggggccacggccgtgtttgcattttctgaacccaggatggtgccactgtggtttgttctccccgttcaagtgttgctgactggtggggagggacagcatcgcctcagtgaaagttttgggttaaacactgtctgcagtaattcaaaaggataagaaggactcctttcactgtgcatctttagacgaagcatcaacaaaggctttttcactgaaatccaaactcaaggtgtatacatgtcacctcccagcacagcaaatggcacagactcgagggaatgttttccttccggaacaacattataaagcagcagcccccagcctgtaggcaccagggactggtttcacggaagacagttttcccacggaccaagggtggtggtgggggatgatgatttcaggaagattccagtgcattccatttatcattagattctctcaaggagcgtgcaacctagacccccacatgcacagctcacaatagggtttgtgcttccatgagaatctaatgctgctgctgatctgacgggaggcagagttcaagtggtaacgcttaccttctgctgtgtggcctgcttcttaacaggacaccgactagcactggtccgtggcctgggggttagggagccctgctctgttacagagaacaaaatttgttacgtagggatcacttgagcccaggagttcaaggctgcaatgagctatgattgtgccactgcttttcagcctggctgagcgagaccctctctataaaaaatttttttaaagagtaaaatttgtatagtttttgggaatttactatggtgatattttatagcgctgtcaggaatgctctagctattggtgggccctcagagcacagtgaattcgagggctctgatgtattctgttgttttttttgggtttttttgttttttttattttgagacagagtctcactctgttgcccaggctggagtgcagtggcaccatctcagctcactgcaacctccacctcccgggttcaagcaattctcctgcctcagcctcctgagtagctgggactacaggcgtgcaccaccacgcccagctaatttttcctatttttagtagagacggggtctcactacgttggccaggctgctctcaaacttctggcctcaagcaagttgccctcccgggcctcccaaagtgctgggattacaggcatgagccactgcgccgagcctctgatgcgttcttgccggtcatttgtacagtgttgcttgcatgtgagttcttcttcaggtcgagattaagggtatgacattagtactaaccattattcaacctctgaaatatacgcacatgggacaaaggagataatttcatttacttatgtggccttactttgaagatattcatatgttagtccattttgcattactataaaaaatacctaaggctgggtaatttataaagaggtttaattggctcatggttctgcagctgtacaggaagcatggtgctagcatctccttggcttctagtgaggcctcaggaagcttccgatcatggcagaaggtgcaaagggagcaggcatgtcacatggcaagagtgggagcaatagagagaagggggaggccccagactctttaaaacaaccatttctcacatgaactaactgagcgagagctcactgatcaccaaaggatggtgctaagccattcataagggatctgcggccatgatccagtcacctcccagcaggccccacctccagcactggggattacatttcaacatgagatttggaggggcaaacctctgagccatatcaccatagttagtgcatgccagatgatttttgcgtttcccacaggatgtcagtgagcctttttctcagtcatggccagccccaacagagaggcaagatgagttcctcttggttgtgatgcctcttttcttttcagttcacactttatgccctttggcttgctgccaggtgctacctttcacccaaaagaaccacaggctcctcacggattttgcattccttcagggtcctgccagttactggcaaattcaatgataattgtgctcactgtataaaatactttctggaataaggtaaaatatgaatgaaaaaatgcacaaatgccaaacaaatacagttgcttgtgctgagattttgttttaaagaagaaagagaaaaacaaagaaattaaggacagcattgcgatcacttttcttcctccaaacaaaagctttcaagcgcaacatgttgatttttaaaattcctttctgggctgggcgtggtggctcacacttgtaatcccagcactttgggaggccaaggcaggcggatcagaagatcaggagttcgagaccagcctggccaacatggtgaaaccccatctctactaaaatacaaaaattatccaggcatggtggtgtgtgcctctaatcccagctactcaggaggctgagagagaagaatcacttgaatccgggagatggaggttgcagaaagccgagattgcaccactgcactccagcctgggtgacagagtgagactccaactaaaataaattaataaatacatgaataaataaaaaaataaaattcctttctgtagccactgtgagccaaaagcacgggcttaaactgcagagtgctgtgtgtgcactcacaaatcccaggttcccagagtggagagccctgcaccccagccgcggccaagggtcagaagtagcaactggtgattaatcaagtggctcctgtcttaggacagtcagcgtttattgtctctgcaggccagactatagaaataagcagacccacaaaagccagcaattaatatttccccggagagattccagatgctgccgggtggactgtgacatgctagcattcttcctgctcctgatttattccattgtgtggaagagcttccacagaaatgactctttggatttttcaggaaatgtttcaagccttcttattcagacaccctttcagcgtccagtgatggacgaagctgtgccctagagtcccaccttcccaaacagtgggcaacttgctttctccagcctcctgtccccttccgagcacccttcacccctcccatccccaggagtcgctgaataggtcccatgggagagaaatgacagcttgaagtgatgacccatcccaccccatcaaatgttggcattttactctggcctccaaaggcatggggggatgacccatggcaggaatacaggccttacagagaggttcactccaaccaaaccatgctgctcccccagtggcccaccatgaaaacctctggaaaaccaacttatttgccaaatgactcccatgagcaggcctttgcaaaatttcagagtgttgtacagctgcatcccaggacaaaactctttcttttcagtactaacagtgcaagtagaatagggtcgtggtggagcatcccattgtcttcattcctggtccactaattttcatctgagttaagagttttgggtttgaattcaagggaaatgaaaagttcttaaaggggccgggcacggtggctcacacctgtaatcccagcactttggaaggtggaggcaggcagatcacctgcggtctggagttcaggaccagcctggccagcatggcaaaaccccgtctctactaaaaattaaaaaaaatagccggggttaatcccagctactcaggaggctgaggcaggagaattgcttgaacttgggaggttcagtggaggttgcagtgaggttgcagtgagccgagatcatgtccctgcactccagcctgggcaacagagtgaaactccatctcaaaaaaaaaaaaaaaaaaaaaaaaaaaaaagaagctctcaaagggcctgagccaggcaccgtggctcatacatgtaatcccaacactttgggaagccaaggcagcaggatcacttgagctcaggagttcagcctgggcaacagagtgagactctatctccacaaaaaatgttttttaaaaattagccaggtgtggtggtgcatgcctgtagtcctggtgggtggccaagtcaggaggatcgcttgagcgtaggaggttgaggctgcagtgagctatgatcatatccctgcccttcagcctgggcaacagagtgagaccttgtctcaaaaaggaaaaagaaaatggcttgaaaggcatgtgagacattacatagtttgaggtatttcctttgctatatgcaaaggcataaaaatgaacagggagctagcggtttattgctggtccgaaccagcaacatcacagctggccctgggcgtcacagggtctcatgggggtaccttaagaggattcttaaatgaaactcagaacacagagaagtagttgattttgtgtcttgcatgttctgactcttcatttagtgtcacagcaagggtcaaggatatgggaaatcataaacaatcccaagagtttcatgatctttgagaatcttaaagcttcatctaagctatgcttttgaattgggcagaaccagaatggatacaagatgaatacagttcaaatgattctaaaactagagattaaatcctgtgaatttcctactctcagcaggaggagattacaactatttccaggtttaagatgatgaacatgattggttttgccccgtgctcactgggctcagatgagaaatagctttaaggtgcatccagggtttggttggttgtgaagaagaatattccttgtcgtcaatgaataaatgttgtgataggtcattagaggaggatctagagccctttgctggaaattgtttgaatttgaagccagagaagtaagcaagtaaccactttgttctccttctttctctttgtttactccattgtacattgactgtctcccaaagtatcccaccgagccttaagaaaaagttccccttaaagataacagaactggaggattcagctaggggctttttgattagtcaagaagcctttgattggatggacatgtaatcccagcactttgggaggctgagacgggaggattatttgagtttaggagttcaagacaagcctgggcaacatggcagaaacttgtctctacaaaaagtacaaaaaaattagccgggcatcgtggcaggcacctgtaatcccagctactcgggaggctgaggcagaattgcttgaacctgggaggcagaggttgcagtgagccaagatcctgtcactgcactccagcctgggcgacacagcgagactccatctcaaagaaacaaataaacaaacaaacaaaaaacaaaaattagctggatgtggtggtgcatgcctgtagttccagctactcgggaggctgaggtgggaagatcacttgagtccaggaggtggaggtttcagtgagccatgattgcaccactgcactacagcctgggtgacagagtgagaccctgtctcaaacaaaacaaacaaacaaacaccttgattgatgatccaatatagttcttttgttgttctttgggccttcttttttttttttttttaatgatcacttatctttcccttgagggaaacctacgttgtaaatagagaattttttttttttttttttttttttttgagacggagtcttgctctgtcgcccaggctggagtgcagtggcatgatctcagctcactgcaagctccgcctcctgggttcacgccattctcctgcctcagcctccggagtagctgggactacaggcgcccgccaccacacccggctaatttttttgtatttttagtagagacggggtttcatcgtgttagccaggatggtcttgatctcctgacctcgtgatccacccgtcttggcctcccaaagtgctgggattacaggcgtgagccaccatgcctggcctgagaaaaatatttttgatttccactttatagatgagagaattgaaattcaggttaatgatgccactcaggcttgaaacttcagcatcatttttgtgtttcttctgcacatcccacattcggtccatcaccaaattctgttaattttttcctcgtgatgttactggcatctgtctttttctcatcacatccactgataccaactggggctttctggatgattatactggatttttccattaccttccacatgctggtcttacctccttgatgcctcccgtaagtattttggatcttgggaatatgaattcatgtctgttcccttcgtttggcacccccatgggttgtgggcacagaggcagggaggctctgagaggcatgggccaggaaaggcttttcagagatttctgagcatacctgtgtcccttacaccttattctaattcacaccagctcttggtgtttgctcttcgactgtggacctctgtggatggtagacaatttgtgtgagtccacgagcccttcagtgttaaacatcattaaacataaggtcgcaaaagtcagctgatgctcaaactgaaattgttgtattttgttttgttttatgttattttgtttcccagaatgaggatatattggtcttattgtgctatgtgttagagccacatattctttcttctgattctgtgttcacattgccttccagatatcatcaaatctaacatgttaaaatctaacataatgagtgaaaatatatcagcgagaatgataatagtatctgctttctaatccatgtgttcatcatgggaaataacaaagctgcatcatatcctgtcttgtttctatcatgtcctcttctccagttagatcctaagtccctccatgacaaagacctggattcgttcacacatttagtgattcagcaaaacacctagtaagtaccccttgtgtggaaagccctgtacttgcctttggtcctatgggagttgcgttgcttgatgttagtgatgtacctaagggtggtgttaggactgaccggggctcccctcccaagccccacctatgtttttaatcacaataccatgcaacttccaaatcaacgctgttgatagaaagacacctacccagctctgaagagttatttggtccctagatcaaggggcagataagtcagatttccagaaagatagagcctgcctctttgtcattccatctccactattccttcactgatgagaaagtgatcagatcagaactgatgttgtataaactgctctgtaattcctgcctgattggcttttcttgagaggtgcctgtccattagcttttgccttccttttgtcaggctctctaaacactttaagtaacagaatcaattaagccttcctcacgattttagaaaactaagtggtagctcaggaggggagtcatcctaacaagctgtctgtgtagacagtggattctgtattgtcgcttttgtttctcaaaggtttgggtttggtcagaggttaccaaggaaccttcgctatatttccacagattcttttgtgagcctctagttcacgccctgtaaggacattcatccttctctgtccttgggagacgtaggaaaattatttcctggagaaatcaggcgcttgtaagagccagcctttcaaagaggtatctaccatcaaaggggctaatcgtccgagtgacagacacgcatggctggcttccctctttactctgccttgattgagacaagatgagcgtgctgctggccttagcaatgggggattctgttagaacaatatcctcagggaatagcttttatctgctaagtatgacaagtgtggcaactgtgcacagagtccagatctcacgacctcgctttgcaaaggctacaagaccaagggcttgtgtacctgccccaacagagacaggctgactcttactacgtggccgtaggaatggtttgcccttgctcaggacttatttacctaatgtcgtttggcctggaatgtttcagagcaccctttcatgcctggtcagggttgtgatcccttttggagacagaaggaggtagacgtgcttttgtgtttccgacactgaggacattgaggttctgggggattcatcacttagctcccaactcttattgggagcagaagtgccactggagtagggtggctggtttgagggtgtggccccgggaaaggtggcaggacacacttctcttgttctccagcccattttcaggcacggtatcctgcgctgctagcaccgtagccatcactgacctcaggaccctcccggtgaacactcagttaaaattcctactcgctgcagtgggaaattttatgttatgtgaattttatctcatgattaaaattaaaaatgaaattttaaaaatgaaatattcagttgcctttcctagaaggaatcatcccgatgatactattccttacttctcacattcatcccattctaatgcccacatttacttcataatgtattacctacgtatagtgtatgttgttcgcttcatttagcatgaccctatgaaatgcctgtgtgaccaaaagcagatcaactgataaggccttttgtggctcagatgtgtctttgcggggaaatggtcaggcgtcctctgttggcaagggcacctgtcccaagcagaaatggagaaacacgtcctcacctcctcctgccacctgctctgaacagattctgtagcgtaaaattctttataaatacacatatcaatggagttcttgacattttgcccagaacctgaggaagaataaaacctttcttgtccaactaaaacacacacggaataacaagcaaaagcaaaagagaaatcccaagaaaacagaccagaaacaaagggttatgctccgtcattgtccccaagagggttacacatgagactcacagggcaaattttatctaaattaaaatgctgatttttcacattacaggcccaaagtttaccgaggtcacagtgcttttaaaattaatgaggccgggagcagcggctcacgcctgtaatcccagcacttttggaggccaacgcgggtggatcacgaggtcaggagtttgagaccagcttgcccaacatgacgaaaccccgtctctactaaaaatacaaaaaattagccgggcgtggtggtgggtgcctatagtcccagctactcaggaggctgaggcagaagaatcgcttgaacccaggaggtggaggttgcagtgacccaagatcgagccactgcaatccagcctgggtgacagagctagactttgtctcacaaaaaaattaaaaaagaataataataatgagtgaagattagcttcctctgaagtcagttccttgtggatcatcttattgcttattttttaacttatttgatatctcactgacccctcccgaggcagaaatttgcttttgctcattgcaaactggccaaggaaaaaaaaagaacaatttcctctatagagtagttcccccttatcctcagatagccttccaagactcccagtgaatgcctgagacctcagaaagtaccgagccctgtatgtgctgtttttctgatctggtaaccagggcggctactgagtggttaacaggcaggcagtgtagacagcaggaggtgctgggcaaaaggaagactcacatcccaggcaggacgaaatgagatggggtgaaatttcatcacactactcagaatggtgtgcagtttacaacttatgaattatttatttctggaattttccacttaatattttcagactaaggttgactgtgggtaactcaaaccttggaaaacaaaaccgtgggtaagggaagactgctttaagatctgagaatgaggactgacatgttttggtttggctggtggtttcagatccaacctcagtagttcctagagaccatttaatttgtttttgagatggagtctcgctctgttgtccaggctggagtgagtggcgtgatctcggctcactgcaaactccacctcccgggttcaagcgattcttgagcctcagcctcccgagtagctgggattacaggcatgtgccaccatgccaggctaatttttgtatttttggtagagatggggtttcaccttgttggccagactggtctcgaactcctgacctcaggtggtctgcccgcctcgacctcccaaagtgctgggattacaggtgtgagccaccatgcctgaccgagaccatttaatttgaataagtgcccaagaagcaaaggactgagccaggcaagatgatctgagagcaggaaggtgtggccaggctggctgagccatgaacaggctggttgctccagggccggtgtctcccctggaaggttctggagttcaggctgtgttggagtccaccttctgcccctcaagtccatggcagggccgttgactgctgctcttgcctgagtctcctggttgcaaaggccaggcaaggcactgcctaacgttgtgactaacatcgtgggtgtgacggggagtcagggtggcttctctgttgccccaagtatgccctgcacatcaccatcttccttttcaaagaatggtgaaaataggaattgtgctctttagggaagattgtcttttttatatctttttcttttttttttctttttttttttttttttgagacagagtcttgctctgttgcccaggctggagcgccagtggcgcgatctcggctcactgcaagctccacctcccgggttcacgccattctcctgcctcagcctcccgagtagctgggactacaggcgcccgccaccacacccggctaatttttttgtatttttagtagagacggggtttcaccatgttagccaagatggtctccatctcctgaccttgtgatccacccgcctcggcctcccaaagtactgggattacaggctcaagccaccgcgcctggccttttatatctttttcaaagaaaaaggtaggctgggggcggtggctcacgcctgtaatcccagcactttgggaggcagaggcgagtggatcacctgatgtcaggagttcgagaccagcctggtcaacatggtgaaacctcatctctactaaaaatacaaaaattagccaggcatagtggtgcacacctgtagtctcagctactcgggaggctgaggcaggagaattgtttgaacccgggaggcagaggttgcagtaagctgagatcgtgccactatactccagcctgggcaacagtgtgggactccatctcaaaaaaaaaatgtagaaaaataaaaacaatcatctattcatggctaggtagaggtcagatttcactcactgacctgtttttagattttccttcgatattccaactcttagatatgtcaggttgctggagttgctgactgcactaacttctgcattctccaactttcccctcagagagtggcttgtctaaatcacccaaattaccatgtgggtgagaatgttggggaaatgaagatttaaaatccacaatattattagtgctgtcaatatcataatatcataaatgtccatacgaggaaaggagaccttggcagaggctaccttttctatctgttttgtgtgtgtgtgtgacattcttcatgaatgacttcttgaactatgaaaatgaggcaactgtggcctgaactctctcatttgcctcctccccttcctggcatttacttaagacatttcctgatgcttcccgggggtgtttcatgctggtgtctaagccagagatcacacctcccacccaccatgcctgcacctccactcctgcaaaggtttttagagtcagggtccctatcagtgtctaagcatcaggctcttcagaccctgacctttgaaaagtccaaatggctcttgagtgccccattttctcccaatctgaaaactgtaagaatgaaatataacaattaagcctcagaggatcacaagcgcaggtgatcctcatgagcccagactgatatttctaaattatctagatcttccttgaacatagactccagagttaccgggacgcagcgttcccattccactgggcagccatctatacgtgaagtgtcattgttggtggtttgggagttttattttccctttcataacacgtctcctgtctcctcagctcccccagaactccctgtaatcatatttgctatcagttgtgtttgtggaggtgtagtgaatttttcagggatgaataccaatgctgagaccctccaagaagacctgtgaggtcagcctctgtcagcgtgacagcccagtgggagggggccccaagctacacagcaggagatgattgtcacacgtcctggtgagagagcctgctcaccagctctggacctgcactccgtgtgcctggccagtagataggtttccctggtgttccccaggccttttctgcttcatgacattgattatatagctagcatttcatttcagtagggcttgggaaagggggttctttattgcagctcctgtaaaaacccatttccacacgaatcacctctggcctttttctgtctggcacattgtttagacaggaggggtttgtgtgtatcacttccctccagcctctcctaagtggaagcctgggatttggaaattgggatttttttccttctctctaaatgaatgccttgttggataccttgttgataaaatgccatttctcacatctttatagcttaaggggctaccttagccacaaggcacagtcccttattactgataagagctactgtcatttcacttatatactttgggagattcatttttgcttctcagcatcatttatgttatgattcatatctaaatttaaggtaaaattttatgcttcaccatcgacttttcaaagtttgtctttgaaaatgatttttaaaatgatctaatccaaacctctcagtttacaggtgagaaaacaaatctagggcagagtttttccacaggggcacgagtgatgtcatggaccagatgtttgtgtcgtagggggatgcctggtgcactgtagggcatttcctgggatctcaagcttctatcctctggatgccagtagcaccctccaagttgtgaccaacaaaaatgtcccctgtcacacagctaagtcataacagagtcaggcataagacacgggtgtcccgactcccccatctgccctttccaggttgggcaacagaattaagctctcaacccacacagagctcagagaattagtcaagagcacttccacaatctccagggagagaagagggtttaggagacaaaagagccaacagcatggaagagctttgtggaactctgggcgatgcatcccctacatggaagagctttgttgaactccaggcgatgcttcccctatacggaagagctttgtggaactcggcagtgcatcccctacacggaagagctttgtggaactccaggcgatgcatctcctcaccggaagagctttgtggaactccgggcgatgcatctcctcaccggaagagctttgtggaactccgggcgatgcatctcctcaccggaagagctttgtggagctccgggcgatgcatcccctcaccggaagagctttgtggaactccgggcgatgcatctcctcaccggaagagctttgtggaactccgggcgatgcatcccctcaccggaagagctttgtggaactccgggcgatgcttcccctacaaggaagagctttctggaactcggcaatgcatcccctcaccggaagagccttgtggcactcctggcagtgcatcccctacacggaagagctttgtggaactctgggcaatgcatcccctaaccggaagagctttgtggaactgcggcaatgagtccactctccccagtctccctgtctacgaatagaacttggcccagtgagtcactgactcaacttctgtgatcttctactagacgatatggtttagaaattcataagatgtgtgtcaggagttaacaggtttaggggaaagaacagaagaggcggaggaatgtctccccatgaatgctgaccctccacatacccagaacctgggactagccccttggcaaagactccatgagcctcatacagtgaatgggactcgttctcagccaggtagacatcagcttgggtctgacccccatccttgtgtgcaagtcctgattcacagagtttctttggcacttttgcttaagctgtaacaaacagccagtctgcacagggctcccttctgtctttccctttaagtcggctcacatttctctcctggtcacagctgtagaggacacacacagcacgaaacatgaggagtgtggcaagtaatgaatgcccccagggtattgccactttctgacagatgaggacaaatgtaatttccagggatttcatagctgagagattagaagctttcctgctgggcctaattctggagccaggtatgaacctgtgtttcccttgtataaaggtaaaagaattctgttactggggctgtggatggagccgattttaacatttgttttttgagctccatctatagctcgtaaggtccaccaggctggtccaaggtgcctttcctctagacacaggatttcatttagtggctgtgcctacatgcaaagcagcaacttcattcaactctctgggtctttgtcttagtgatgccagaaataacaaaatagaaactgaactattacatgaaatgacttttgggttggaaaaacaggctctaagaacagagttaatgaactgagagaaaatagtttctggttatgctactagaaactgtggtttttatcctcataaatcattgctttagggaaaaaaagtcctttctaaacttttcctgtcctgtttccttttcattttttgaatgaatgaacagtagggtattctctgtctttgagttattttcttcctagccacctggtcataatccagagggaaaaacaaattagatggattctgtgagctatatttcattgctattggtgtgtggatcacaatgctttattttccaccagttaaacgaagaacattctggaaactttgcacaaagaaaaattagtgtttatccctacagttgaaattttctaggaaaaaaaaatagcaacaaattaagttttgaaaaaggagagccaggtgcagtagggtgcatctgtagtcccagctactcaggaggctgaggcgggaggaccactgcagcccaggagttcaaggctgcagtgagctatgattgtaccactgcactccagcctgagcgacagagctagactctgtctctaaaaaaagaaaatttaaaaaggaggcttggctgggtgcagtggctcaacgcctgtaatcccagcactttgggaggctgaggcgggtggatcacctgaggtcgggagttccagaccagcctaaccaacatggagaaaccccatctctactaaaaatacaaaaaacaaacaaacaaacaaacaaacaaacaaacaaaccaaattagcccggtgtggtggcacatgcctgtaatcccagctgcttgggaggctgaggcaggagaatcacttgaacctggaaggtggaggttgcggtgagccgagattgcgccattgcactccagcctgggcaacaagagtgaaacttcatctcaaagaaaaaaaaaaaaaaagagctttgattttcatgaataccagtctatttctgaaggtttcccccttggaggaacagtggtggcgggctggccctctcagtcaaggagacgtgagcattccatgagacacgggtttcctctagggtctgcccctgaggtacctgaggtttggatacctctgcccactcccctctgccatgtttttccagctgtaccgtgccgataatcactgtgtcagctgtcattaccataatgctctgagcataactgctgtaacagctgggaaagaactctgcctttgcaaaacaatgctgcgtcataacacgctaaaacccccaatgtgcccacccaatatttcctatccatttgccccttctgcactccacaggcatgatcttccctttgccagtgggacatcagaatgagactctcttctgtcctccctctccttccccaagaacagtccttgcttgcaaatgcaaacagagaaaaagatactacccgagtgagcaggtgtttccgttggggtctgacaggagaaagacaccacacttagatcgggactatttagaaaagtatggatggagtgtagaaaatgaaaagggctaattagatagaccagggctagtcatagcagagtgccaggatggcctaggtccgaagggtcaaaaggagggaaccatgttggggggacagaggaaaggaaggtgtggcggagcctccggactcgcctcctccctccagagggcaagggggttctgctgatgcagtccaggcaggcccactccctggacaccaggagagtggaaaagggtggagactgagtctggagggcacggaggaaaattggctcagcatggattagaacagtctttcgcttcctggagcttaaaagccctccttacttacccttagctcctgccacctctctttgtccttggatggatacagcgcatgcctcctgcctgccacctcatctgtggtttctcatcctgtttgctgtcctccttcctcgttctgcccatgctgtcataatggatggaaaagctaaaggtgatttccagtcatctcttttgctgctgacagcatgaagtttgttctgctattagaatgacgcagacccgagacaagggttttgtcctgagttcattccattaatttctctctgcatagagcatctttccagcagctcctgcatgattaaattctggctgtgtgggacacaatggcacaggaagagcgttggccactcatcagccaggtcactaaaaggcaagttccacacatgaggagaaatcaaatgctcaccctttggacatccatccttttggtcctttgagtaacatttaaacaattgtttcttcagatacatggtccacactcaagagacctacaacagttggtatcacctggataagtattcaccaggctctctatgcccagttttttcccaagttccaaccaagagctattgatggctttgctcttgatcagaatagcattgggttttgctgcaaatatattcttgagcattatagtgatgaagaaagaaagaaagatagatagatagataatagagaaatagaagataggtagatagatagagaaagaagcttgcgtgtgtttgtttcaaagaatggggtcagttttcttacagccacctattctctcgcctggacatatattcagtgaatgcttctgtttgtaagatggctaactgggatatgggtcttacaggtcttcagttcctataagagtctacaaccacagcctcattaacacatgctctctggtgaaaagacattaaatggggagggaggaggtgtggatgctacgctggcttcaccacatgtaattattgaactttgtatatcactttacctttctgggtctcagggaccttgtctagaaacccaacaaggcaggctgtggtagctcatgcctgtaatcccagcactttgggaggctgaggtgggaggatttcttgagcccagaaggccgaggccacagtgagctgagattgggccactgcactccagcttctgcaacagagagagaccctgtcaaagagagaaagaggaaggaaggaaggaaggaaggaaggaaggaaggaaataaataagcaataagcatgaagtggcagttattctccaagtgaacagtgtggagtaactgccattttactggtactcaagtacttggtgtaactgctacatccaggcaactgctgagacttgagcaaggacctttacagcctttggaagtcccatccgtcagacacaccagggagcccgatgctgaacttcatgtctgtgtttgctgaatgatgagcaggtcctcttcagcgagagctacacgagctgtgaatttaccacgtgcccgtcaagggggtcattgtgttcctcactctgtcaataaaccacacagtaaagatctggataataggagcagaacagtttcaaaggacttgttacaatgtatcaagtcaataacttataattttagaaaatccctgaatacaaatttgcacaattttgagttgttttacaacttaccaggccgttaatctaagttttaaaagtctcttaatatacttaatcatagcctgtgcttttttttttaagtgctgaaatatgtttcagcattactgaaccacagcagcacaaggaaaaaacgactttaactcgttccataaaacttgcaaagcaaccataaatatatacagtgtggggtctgttttgtgcacaatttatatgcaataggctgggcttgatcgagaggatttatgcttatcgtctgtctccccaggcagacaattgtggtagaaaagaaaatgcacaggacctagagtcagggctgggtttcaatcccatttctgccacctgctttttgtgagaccctagggaagccttttgctcctttgaacctgtctcctacttaacaataatatgcccaccttagagggcagctgtcaggattgccacagagcaaggcagaggtgagccatctgcagatgcgtgctgaatttaaaccaatgcatgagtgacacggagcatgagagtggccagcatccttcctctctccctgcaccccgcaaaacaactccatcccccactctctctcagaggtggcagcggccataattcagacacatgcaacccagccagcgtaaccaccccctactcaccccctgaaaatagaagaagaaaggatttagagtctgggcagattgcttttaaaacatttccaaccttcgatctaatttgtcattattatttgtagagctttctttctcttccttcgtatctcctttcatatccggagcattcccagggaagatcccgttgctgaatactcgtgtctccagttttctacccggacttaaagatctactggtcctgcagagctgagctccagtggtgtgaaaggcacgtgagcgatgctgggcttgtggagatgagtaacacacaggcttgctttcaaggcactcacagccttacacatttgaaaatgagtttttcactggagcctgaaacttccagatttgaaaccatctccggggccaagcctggctgagactctctctctctgcatgagctgcctgccaccatcagttccccacccagatacccaagcctgaccttgacctgctgggggaaattcattatattctcgtttactccattttatagacgaatgtttcttatcatgaatgagagttcgttaaatcagctggttctaggtggagttcactagagccctctccaatgctgccggaggacctgttgccgtctgggctgtattgtaggtgggtggtatcataataagatccgtggtacacgaatgggcttcagggcaggcctgggttacatcaccacctcactttcggtgtgtcaaagctggaaaaaacagctggaaggtggccagtgttcgcttacccaacgaagcatgactttgcatctcctctaccctgcccagtgagggctccctgttttgaaggactggcatattctggaatgcttccaccaaatccaaacatcattctggatgaactgtggagcagttcaccgttcacagttcacaaaaggaccctctgtagaagcagaggatctttccctggggaaattatcctaagtcttctgattttaataactgatatagttcaagtatttgtccccgcccaaatctcatgttcactgttaatccccagtgctggaggtggggcctggcgggaggtgactgcatcatggatccctcgtgactcggtgccatcctcatgatagtgagttctcccaagatccggtcatttaaaagtgtgtgtttcctgccccgtctcatgctcccattctcatcacgtgatgtgcctgctcccacttcaccttccaacttgagtcagagctccctgaggcttccctagaggctgagcagatgccagtgtcatgcatacacagcctgcagaaccatgagccaattaaacctcttttctttataaatacccagacttgggtatttctttatagcaatgcaagaacggcctaatacaataattgttttccacatgaaataaacattgaccgtcttatccaactatacatgcttcttgactctagaaattgttgaatggaagtgctaaagattatcctcaaacacactcatgtgcacacagtttcagtgccagaacagtgtcctctaggaggaaagatggtcccagagcaattactggtttcctttaattttggcttcctaatgagtatcattttggtacgattccaatgaattgtttatttgaggaaagagaaaaagaaaagaacctataggaagagttggtttggattctatcgcgggcagtttatgcttctacgatagtaataaaagcaatgagagaaaaaagctacagaaccaaataaatatagatccaggagttgtacaacttttaaaagaaaaattctttagcctattgatccttcctaaggtaaacatttattttatttcagtttagaactcaagaatttttttcaagtacaactgaggaatagagtcagaagccacttcgattttgacaccatagaaacattctttctttagttactagaatcttttaaattgataagattggcattttcccaggatataacattcacctccactgtgtttttaatttgcaatagattttgagggaaagattccacaaggatttggccaacatgcctcctgagcagtgggtctcaagtgtggtccccagaccagcatgatccccatcagctggaaactgttagaaatgcaaattgtcaggccctaccccagacccactgaatcagaaactctgggaggggaaaccaacaatctgtgtttcaacatgaagtctgagaacttaaactatgcaccgttcttggtaagaaaataagagttttcctttgtgtgcgtatgtgaaaccaattccctgcaacccacagttgtttaaacaaaaacgtgtctagggagttcaaattaggtggccaattgccttataaaagtttacaaagtaaagagtctgtgctgtttccgttaggagacagaaacccaatcactaacttggagtatgagtcagaggcaggacagagaaatgtctgtctagtcggtgagctaattaatacgtgatcctgaggatggaggagccagggctgccgttccttctccactagggaaaaaaaaaaaagatgtttctctgtcaggcagctccctagctacctccagtatgttctattccatggctagaggagtgcagcctacatcctgtggatttatgtatattactgtaaaacaagctttctcttctcgagagttccgaagcagatctgtctctgattctttccatgaattcaaatacattgtcatccttaggtttcctaggtaaaggagactgcattactcatcagcatttaataaatattcatttgttggttgactgattcattatccttcatgccaatcacatggctgctactagcatgcatacagccgactcttaactacagttgtgtcatctacacaatccctgcagaaaactcattgaacacgtagtcgacacatttaaaaatgctgtgctgtggaagtgcaagttgcacaaacattttcatctttagcttcacttagaatacatttttttagttttttaatgtttttagagacagggtctgcctctgtgacccaggctggaatgcagtgctgtgtgatcatagctcactataacctcaaacttctaggttcaagtgctcctcctgcctcagcctcccaagtagctggcactataggcacacaccaccatgaccagtgtgtgtgtgtgtgtgtgtgtgtgtgtgtgtgtgtgtgtttgttttaatagagacggggtcttgctatgttgctgatttcaaactcctggcctaaagcaattatcctaccctggcctcccaaagtgctgggattgcaggcatgagccacctggcccatctataactaacttcataacactccaaattggaagaaagttggtggtgttattagcattattttacagatggagaaattaacacctggagttttgtgattacagagcagtggtaatcacccagttattttccttctctgtccctccagtggccctctgttgtctgggttaagtacagactttttagtttgaggaaaggagtccctccacaatttgtcattcctctattcttccagccaaatttcttacttctcctccaccctcaactacagtcaaacatcaaacaggccgggcgcggtggctcacgcctgtaatcccagcactttgggaggccgaggcgggtggatcatgaggtcaggagatcgagaccatcctggctaacaaggtgaaaccccgtctctactaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaacatcaaacaatactcactgagcccttcccacgtgccgggctatttgccgagaacttctcatgcattatctcatttaatcctcatcacaacttctctcaggtggaggcatgattgccatcccatcatacgggtgaggaaactgaggctcatagaagtaccttgccccaagccccatggctacttgcaggttccaagacaccggtcagcctgcccccctgcaccttggccatgctgcccactcacctagagcgcacagctgacactgagtcctcttctgaacctcatccatgaacatatttatgaaatctttcctggccccaagtggaaatgccccctcatttgggtcctcactgaaccccagtacacaactcttttgtactactctattatgctggggtgtttttttattgtctcacctgataaaccgtaagccccttgaagacagcaactcgtttttaagctctttataaccccagagcctcgcacagtacctggaccagattaaggggtacttaacagatgcttagtgaaggaaggaatggatttctcacctggttgcttatcttctagactcatttggggagtggccaggagtccgggagagctgccggccattgttccgtcccgtctgtatcccttgggctagtttcttctagactgaggtttctaagtccaaacaagatgaactgtgcacagtgcctcaattagggaacagcagcttgagtgctttggaaatacaaaagtgtagtttgtaggttcaccttgaaggcaagatcagacagctctacgtaagccagagctctgaaacaaagcttcaggctgggaccactttgcagtctcagtgcctggtagtggggactgttctacagagccgtgatcaaacctccaactgcattctggtcttggaggaaagctgattccgtatgaagagaaaaggcctggtgagagtatttgcagggctgaagaaaagttaacatctatagtttggcaagcagcagctgcaaagcatccgtcccagcacatgataaatgcttctgacgtttccttcagacacagtgtgctaggaaggcttttaagttctcaaatgcaggagtctgccttattgatcaggtgcctttcattaaaggtttccaagcccctcggctacagaggaaacgctcccctcagcctcctccacagccccagcctttcatgcagaggggattatcattgttggaatacggcatatactttaatttggtgaggctttttgtttaatgcttatgatatgcacactggaacagactgggattaggtaattttcacattgagttggtacttccctccctaacccccatctgatcttccatatacacattttaagaagaaaataaagagaagacacgtcctcctaatgatcctccgtattagaacttaccattctgctttgaactcctgctgctttgagtctcccactgccagcaagcacttctctgccaggcggaggggcggtgaagggaattaaaggggcagtcagtggcttgcctctggcgggaggtggcggagcgtctcattagcgtttgctcctttcctccagctgggcttcactgggcccctcttcttatcaacccgtccttcacttcacccaggctgtcccctgcactcagaccccctccagtccttccaacaagatggcagcaggatgactgggactcattggagctaagcagagaattaaagttgcttttgttccaaacctaaaacttgaaaatgaaggaactcttacgtggaaatgccaccatctcccttttgttttatgcgtaaacccaactggttccccatcctctgggtctccttcctgcccctcgctggctcagggcattgtacatactgtgtgttcaacacatgctgagtggaattgaacagatgcagtcctgggaaagggggccttttggaagaactgatggggaaagaattggggtaactgtgggcagttactggacgttcttgctcttacttattggttgaatgagaatgaaagtatctaagatgtaccaagtcccagggatagtggcataatttctctgttcctccttctgactccctcttctcccctcttttagtgtggggaagttacgagaacgtagcgtttggtgcagtgatccattcagtatacgtcgggctcttaagaaagttaaatttacctaacatcctacattttagataagaccgttccagatttccacctcttgacccaaaagatcccttcggtggttttccttactagggcaattcccttagtttcttggattcttccttcctctccttcctggaactaagctgcagagtcccaggctggagaaatagcccactgcccaggggtattttagaaagggcttcccaccttccgcagtgggcctggagaaggacgccttcttttcaccaccaggctgtgatctcgcaggctggcaaggcctttatgatgaactgaatgcggtctgtatttacgtgcctgccatctgtccccaggcggcactgagaagggggctgatgctgtcacccctagctccttctgcaggtctcctccgtacgtgccactgccaggaacaaaattatcatctcatgggagctgcacacatttaatggaacttgggagccagcacagaccgttttcctcaaagacagttttataaagaaaatggactttggggaacaacgccagaaagacatccagtatacctaattattaggcgagtgtggtcattgcctctttgtcttagataactaggttgttgattacggtgctttgccaaactccacggtggatctggtagctggtatttctgggcagacaccagactgagttacttcttttcagagttctggacgttactgatctaggtgaaaggccagaagcagtgggatattgaaattctcagaagtggagagactgtggcaaggaggtacagaagacactaaatcgggtgccatgttagcaagctcaagttttcatattgatcatgcagtgagctgcagagaagaaaagcagctttgcctgggtcctgttgttctccaagccaaatagcatctctgtgctgacagacgagtctgcgtctgcagacgcagcatctcttgactgtttgctatttaacgacagtcgtaacacatgagtgagctttactcatgtgggccctttattaacaataagccgcctctgtggcggctgggccccgcggggtcggggggtgggggtgcccaacgtggcagggaggcctgcaaggggaggccgaggcgccggtggaagcacaaaccacccggcgagtcagagcaggggtcggggcccctggccgcaccgtgccgcgcatgcgcagggtcccggggtccctggggtcccgggtttgtgcccccggggcggctgggccccgcgggaggggacggccaacgcggaaatgggccctttattcacaataagtgccaaaatccaaactgaacacatctaaaaaaattctaattaaggagcgtccactgctgctttctcaaaaattccttctgtgctattaaatattttctctttccaatggatatttaccatttctactcacagtagtttttctaccaagtattcagaaaaacctccagttgtcacttacccagtgtttaccaaaaatcaggcagaagagcgtggtggaagttggaagaccttagtgtaacccgcgtctataaaaactgggcgtccaggccgggcacggtggctcacgcctgtattcccagcacgttgggagtccaaggcaggaggatcacttgagtccaggagttcaagaccagcccggacaacatagaaaaaccctgtctgtacaagaaatttaaaaattagctgggtgtggttgtatgtgtgcgtcatcctagctacttgggaggctgaagtgggaggatcacttgagcctgggaggcagcggttgcagtgagcagagctcacaccagtgcactccagcctgggtgacagtgagatcctgtctcaaaaaaaagaaaaaaaaaaaaaaaaattggatgacgttgggcaagtgtggtgtctgtctcagctctgtgagtgtaggatgattcagaatctaatgattaggtctcctgaactcctaggtcaaacgtggttaaagggagatccagggaagcagtgaggaatgggctcttacaacactgtcatggacatgggttcaatatgttggcaattattatttattgaggacgtactttgttttaagtgcttaggataattatttgcttaatagtcacgtaagtccttcaagataggcattattatcgccattttactaatgaggaaactatgttaaaataatatattcctggtcacacagcgaccaagagtcaggatctgtctgccttcagagttcatagtctttccagtagcctcagtaaaaagtaataatagctaatatttactgagcacttactatgtcactgacattgtggaaagggatgttatgggcatttgctcttttaatgatcacagtaactctgctaggccagtactgttattatggccgatttatagatgtggacagaggaggttaaacactcgtgcatggacacatactgatcaacgtacagccagcactcaaacccaggccgcctgtctccagagcctgtgcccccaagctctaggccatgtgccctgtaagtcgcagatgggacgctctgacagcgagtgtcactgaggtcggagtgggtcatcaggcatgcctcagaatcccattccccacttcattcacacctgagaacgcctgtctctggatgcatctttacaccagctcatccatttaaaatcagttccctaatacaacaagctgaggatgaggccccttctaactaggccaccgtcagagtcccaatcctttctgacagaccagcccccgacatgtgtctgtctccatccttgcagcctggccagccctgtcccacgcctgctaattggtggggggacctggccccccaagcctgccggccattagcagtgcctcacggggaagggctttcttccttggtttcaactccctccctccagcgcgcagtcccttgccgggcttgcctggtgacagactcgtgttgatgaagacctttagggaatttccttccccctccgctccccgaagcgcttcttagagcacatctcattaccgggctccattctcccgtcctgcacatgctccctcacacttagctttattgtgccaccacttgtcacctttcccggcccggtttttaataatgcaaatcttccctctctgatggcatcgctgctcattatttgctgtctggcaccacgggagctcacccagcggcacctcggagaagccagccgcccagggtgcaggcgcaggccccactgcccgccccagtctcctgagagatggctccgctctggctatgacccaagatgctcatggagggaagagcagtccagggccagggcccttccaccttcgccaggcaggtgcctttgagcaagtcaatctctgcagcctcaaaataggaaagatggtaataattattataataatatccccttaacaaagcagttatggggcaaccaaatggaagtaagatacgagaaaagtctgtataaactgtaagatttgtaaaacttgtaaagaagttgtggtggtgttgctgatggatgattgattgatttggtcaacacggagcagtcgctgccccaaagtaggcctggagggcaccccagccccctcatctgccctcccacccccaaactcagcatggaatcatatggctttggactttctccaggtggataaagccccctgatctttgaacatgtcatgcaggattattattgtgtgttttgtttgggcaaagaaatttaagccaatttacttttgttctgtaactcataactgaactgtgctcagagtctctggggtcctttcaggcatgggtctgtggttctgtaatggtaactatgggttgatggagcaatggctttgtaaaatatgtttaaaagctccctctgaattgagggatcacagcctccttagttgtcccctggatttcctggcattggagttatgtaagacctccatgatcattgccatctggaatatgactctttggtaccccaaaaaacttctggagtctttcagtcatatggaatcaaaaagatcttcctttggaagaagcaattttagatcactgatggaaattttaccagaaaagtattcaaatcttttccttttataaaacctgggtttgttttttgttttttaattatactttcagttctgggatacatgtatagaatgtgcaggtttgttacataggtatacacatgccatggtggtttgctgcacccatcaacccgtcatctacattaggtatttctcctaatgctatccctcccctagctccccagcccccaacaggccccggtgtatgatgttcccctccctgtgtccatgtattctcattgttcaactcccacttatgagtgagaacatgcagtgtttggttttctattcctgtattagtttgctgagaatgatggtttcctgcttcatccatgtccctgcaaaggacatgaactcatccttttttatggctgcatagtattccatggtgtatatgtgccacattttctttattctgtctatcattgatgggcatttgggttggttccaagtctttgctattgtgaacagtgccacaataaacatacgtgtgcatgtgtctttatagtagaatgatttataatcctttgggtatatacccagtaatgggattgctgggtcaaatggtatttctggttctagatccttgaggaatcaccacactgtcttccacaatggttgaactaatttacactcccaccaaaagtgtaaaagcattgctatttctccacatcctctccagcatctgttgtttcctcactttttaatgatcgccattctaactggtgtgagatggtatctcattgtggtgttgctttgcatttccctaatgaccagtgatgatgagctttttttcatatgtttgttggccacataaatgttttcttttgagaagtgtctgttcatatccttctcccgctttttgatgggtttgtttttttcttgtaaatttgtttaagttctttgtagattctggatattagccctatgtcagatgaatagattgcaaaaattttcttccattctgtaggttgcctgttcactctgatgatagtttcttttgctgtgcagaagctcttagtttaattagatcccatttgtcaattttggcttttgttgccattgcttttggtgttttagacatgaagtctttgcccatgcctatgtcctgaatggtattgcctagatttttgtctagggtgttttatggttttaggtcttacatttaagtctttaatccaacttgagttactttttgtataaggtataaggaaggggtccggtttcagttttctgcatatggctagccagttttcccaacaccatttattaaatagggaatcctttccccattgcttgttttgtcaggtttgtcaaagaccagattattgtagatgtgtggtgttatttctgaggcctctgttctgttacatttgtctatatctctgttttggtaccagtaccatgctgttttggttagtgtagccttgtagtataatttgaggtcaggtagcgtgatgcctccagctttgttctttttgcttaggattgtcttggctatatgggctcttttttggttccaaatgaaatttaaagtagttttttctaattctatgaagaaagtcaatggtagcttggtgggaatagcattgaatctataaattattttgggcagtgtggccatattcacgatattgtttcttcctttccataagcatagaatgtttttccatttgtttgtgtcctctcttattttcttgagcagtggtttgtatttccccttgaagaggtccttcacatcccttgtaagttgtattcctaggtattttattctctttgtagcaattgtgaatgggagttcactcatgatttggctctctgtctattactggtgtataggaaggcttgtgatttttgcacaatgattttgtatcctgtgactttcctgaatttgcttatcagcttaaggagattttgggctgagacgacggggttttctaaatatagaatcatgttatctgcaaacaggcaatttgacttactctcttcctatttggataccctttatttctttctcttgcctgatcgccctggccagaacttccaataccatattgaataggagtggtgagagagggcattcttgtattgtgctggttttcaaagggaatgcttccagcttttgcctattcagtatgatattggctgtgggtttgtcataaatagctcttattattttgagaaacgtttcatcgatacctaatttactgagagtttttagcatgaaggggtgttgaattttgttgaaggccttttctgcatctattgagataatcgtggtttttgtcattcgttctgtttatgtgatggcttacatttattgatttgcgtatgttgaaccagccttgcatcccaaagatgaagccgacctgatcgtggtggataagctttttgatgtgctgctggattcagtttgccagtattttattgaggattttcacatcgatgttcatcagggatattggcctgaaattttctttttttgttgtgtctctgccaggttttggtatcaggatgattctggcctcataaaatgggttagggaggagtccctctttttctatagtttggaatagtttcagaaggaatggtatcagctcttctttgtacctctggtagaattcagctgtgaatctgtctggtcctgggctttttttggttggtaggctgcgaaattactgcctcaatttcagaactagatattgatctattcagggattcgacttcttcttggtttaggcttgggagggtgtatgtgtccaggaatttatccatttcttctagattttgtagtttatttgcatagaggtgttcatagtattctctgacggtagtttgtatttctgtgggatcagtggtgatatcccctttatcattttttattgtgtctatttgattcttctctcttttcttctttgttagtctggctagcggtctattttgataatcttttcaaaaaaccagctcctggattcattgattttttgaaggattttttgtgtctctatttccttcagttctgctctgatcttagttatttcttgccttctgctagcttttgaatctgtttgctcttgcttctctagttcttttaattgtgatgttagggtgtcgattttagatctttcctgctttctcctgtggacattgagtgctataaatttccctctaaacattgctttaaatgtgtcccagagattctggtatgttgtgtctttgtgctcattggtttcaaagaaattatttatttctgccttcatttcattatttacccaatagtcattcagaagcaggttgttcagtttccatgtagttgtgcagttttgagtgagtttcttaaccctgagttctaatttgattgcagtgtggtctgagagactgtttgttatgattttcatttttttgcatttacttccaattatgtggtcgatttcagaatatgtggtgctgagaagaatgtatattctgttgatttgggttggagagttctgtagatgtcttttaggttcactcagtcctgagctgagttcaagccctgaatatccttattaattttctgtctcgttgctctaatattgacagtgggatgttaaagtctcccactattattgtgtgggagtctaaatctctttgtaggtctctgagaatttgctttgcgaatctgggtgctcctgtattgggtgcatatatatttaggatcattagctctgcttgttgcattgacccctttaccattatgtaacgccttaattgtctttttttaatctttgttggtttaaagtctgttttatcagacactacgaccgcaacccttgctttttttgtttgttttccatttgcttggtaaatcttcctccatccctttattttgaggctatgtgtgactcagatgggtctcctgaatacagcaccctgatgggtcttgactctttatccaatttgccagtctatatcttttaattggggcatttagcccatttacatttaaggttaatattgttatgtgtgaatttgatcctgtcattatgatgctagctggttatttttcccattagtcgatgcagttttttcatagcatgaatggtctttacaatttggtatctttgtgcagtgggctggtaccagttgatcctttccatgtttagtgcttccttcaggagctcttgtaaggcaggcctggtggtgacaaaatctctcagcatttgcctgtctgtaagggattttatttctcctttgcttatgaagcttagtttggctggatatgaaattctgggttgaaaattctttaagagtgttgactattggcccccaccctcttctggcttgtagggtttctgcagagagatctgctgttagtctagggaagatgggcttccctttgtgggtaacctgacctttctctctagtgcccataacatttttccatcatttcaaccttggtgaatctgacgattttgtgtcttggggttgctcttctcgaggagtatctttttggtgttctctatatattctgaatttaaatgttggcctgtcctgctagtttgaggaaattctcctggataatatcctgaagagtggtttccaacttggttccattctccctatcactttcaggtacaccaatcaaacataggtttggtcttttcacatagttccatatttcttggaggctttgttcattccttttcattcttttttctctaatcttgtcttcacgctttatttcactaagttgatcttcaatctctgctatcctttcttccgcttgatcgattcagctattgatactgtgtgtgcttcatgaagttctcatgctgtgtttttcaactccatcaggtcatttgtgttcttctctaaactggctattctagttagcaattcctctaaccttttttcaaggttcttagcttccttgtattgggttagagcatgctcctttagttcagatagagagatgataagggatcagaagaggccagtggtgaattaactctgtagcctagaaccttgtaggggtaaaaactatttatcatcacctacacactcttactgggcatttattgtggccaagactcgggttcctgtgtgtctgtagagggccttcattgtgggtatccacaaagtgagttgaaacaaagctcatgcatgagaagcgctgatggagttctcccttgctcctgccaccttcttatcatctgtagtctttttcttactgctgagggatccttccagtggtcacatttgcccatagccctcctgaacgcttgagtctgcagaaaacctctagctggacagcttctgggtagagaaacaggccatgaagagcctcctacatgtgcaccatgtggctacgctccgtgacgagggaaaaacaggaatatctgtctgctgtgatcacgtgtagtggtcacggtgagagatgacggggctgctcctcctcagcctccagtcaggctgtgtggcagcgatcacctccatgtcgatggagtgtctgtgcagtttgggagcgaggctctgcctctctcggtgagtgtctcacagttcctttctccctcagccccatgatgccgtccagaacaaggtgctgaactgattaatgagcaggacataaagacaactgctgtccagagcaacagctgtcccaatccatccgtggaataaacaaacagggcagagcgaggtcccgaccagtggggacttgggtgcaggaaatgccagtctcttcttgcttgaatcagggtgtcagggggccttcctggccaccactcaggctgttcctttagctttctggatcccattccctgcaggtctacccttgggagtgaaatagtgaccgtccctttgagcccgagagctggggagaaggccgtgcctgttaacagctgcctggaccctctctggagagcagcagggagaggcggggctggaggagatgttgccaagaacctaagggtgttagtgacaaaagcaagaactcctggcaacaagtccgagggactttcttgatcacaagtggtatctcctaagcactttaattatagcagattaagcaggaagtggagtgccggactaaaggaataatgatacaaaggaggtgaagcagaaaaacttaatttccttcctttaagggaaaaaaaagtccatttatttagacgcattgcaaagaaaagaatggagtgtggcctttcccccagctcggagctcagtgggtttttaaagaactgtgtgtatctctttggccagaccagcgactgggatcttcagcctctctgcagaaaatgagccgcaggctcgggatttcgttaagatgcaggagcattccttctggaccaatgactcactcattcagccccttctttcccgcttctccttgtcagccctcgcctggctgagctcatattttacattcagcacctctggttacccagaaattgcatgcaaaattgtgaaatagaaaagcagtgggctgtgggctccatcagctctgcctggcgttgcatcatccttgacttgcaatgctcagaggctgggctaggagatttgcttacagaaagcctgaaggtcccagggaccttcccaaagttgcgacttgaatgcatgctcttagcacacatgctgtgtaactggggcagatctgtaggaatgagtggaactgaaatcagaccttagaaagtcacagtgaataagaaaattgccagaatggaatgcagatatacctactggttactgtcctgtatgtagcggctgtgtgggatttgactgtgttttactaataggagccttgttgggcccagtgcttcataactagctctgtctgtcgggaatcccccacagtatcctgcttgtgattcacgctatccagagtccagggcaaggagttctaaaaccttatcatgttttgttttgttttgatacagagtttcactcttgttgcccaggctggagtgtaatggcgtgatcttggctcaccacaacctccgcttcccgggttcacgccattcttctgcctcagcctcccgagtagctgggactacaggcgcccgccaccatgcccggctaattttttgtatttttagtagagacggggtttcaccgtgttagccaggatggtctctatctcctgaccttgtgatccgcccgcctcggcctcccaaagtgctgggattacaggcgtgagccaccacgcctggccgttttgtttttgagagacaaggtctcgctctgtcacccaggctggagtgcagtggcatgatcatagctcactgtaaccttgaactcctgagctcaagtgaccctgctacctcaacctcccaagtagctggcacctgtaggtgtgcaccatcacacctggctatttttttttaattaactttttgtagagatgggctctcaccatgttgcccaggcttgtcttgaactcccacctctgcccacatgctgggcattcaattcctagatctcttcctccctcctctcttgacttgcctcctcctggatcatgatatcttatcattttccaatcacagcgttaatggtaaggcttgaggctgggcgtggcacccatgcctgtaaacccagtgctttgggaggcagaggtgggagttcaagacaagcctgggccatgttcagcactttacatgcccattcactgagtttgcacagccgcccatatgacgggcattgttattcctactgtacaggtgaggaaatgggggctctgagaagtgtgactgtttgtgggaggcagcagctggcatgatggaaaaagtgtaggcattggaggtgggatccaagtccagtcttccacccacaggttcagtgatgtggggcaagttatataacacagttttctcatctgtaaaatctggacaggcatacctacaccctggagcattgggaggattaaatgagatcgtgtagataacagcatagtcctggcatatgagagaaaatggcagggatctttctatgacctcagtgtgagaagcaagatctaaaccctcagaggtagagtgcgtcccacactcgggctccttctactgggacactggcttccggatctccacggagaactgttcttaagttagaaggcaagcacagcggggacacggtgcaggacacctgcggacccagtgcccttgggattctttaccttcagctttgctcactgcagattagtcctcatcgctcagcagagagagtcgagattggcaggaggatctccgtcttgaacaacattatgattctctgagcatttctatatgttgaaaatattttatttaaaaattacaaccacccctcctcctcaaaattgcatgacagagatttcaccaaacctgacaactgatgagacaaagagaacaagacacagagaggaatttagaaataatccttgtgcataccttccgaagttgccacatattactaaaattacctgtatctgtgtctatcctgctactctatgcattacatatctttgcatcccccatgcctagcacagtgcccagcacatagtaggtgctcaaaaaaagtgcccatcatttgttggactgaactcacaacacagtaacaaagagccagttagagcaaatgctgtcccttttcccaggactgtagcttccagacccgtgtgaggcctcagcctgatttctgttcaccttagaaccccaaggctgactgtgcatttccataagcacctcgctcgcctgcaggacggggctgggttggtggtgggtaccagaggtgctcagtgttcaatcacgcagaaagtgggctaaagggcagcgcctcctgctccctccagagatgcacttccattctctgaaacgacaacttctctgcactcgcttaatgggatcccaaataacacgtcgcagaccagtcttttatcactgttgccccttggaacacatttcgaatgctggccattaaaagcaggccatttcacggttctttaatgatgacactaataactgtggatttttgtctcccagagtcctgatgagctgagccaaggagtaaattacggagctaacttttatgtgcatggtttattgatctgtgagcttcaaggaaactgcaccagcccctatagtttggcagtccagactaccttttcatctgtgtaattgggccacgagggcgcagttaatattcaatttatattaataggaagacaaagaacatgatgtgccagctccatattgaagtaatgggcatatcaaaatattctacctggtaattataaataaatcagttttcccgtgacccaccaaggatgatgttgctaattcactgtgcatttcatcataatttatcctgagaaagttcagtgctgccatgtgcatgtatatcgcagagtatacaagggtgctccatcgtaaaacacccagctgtcttcatccatgctgtcgcccatcttttcttaacaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggtgggtatcagccccctctcaggctcaggcaacgttgatgaaagggcaacgtttactcattcacaagggcccttgagctgggagggtgtcttctggagcattctgatggaccagttccttcaggagtcaatctgagctccaccgaatggtccagtgcttttgaattactggtgtcagaccttgggcaggatcagtgtgcacagatttcaataaaatctgtccttggggagaaggaagtgtgagccagtcagtggatcacacacagaagcaggaagataacagaaagggacaaggacaatgcgtcaaggtgctggtgacagatctagtaggaccctactcctgcctgggcattgtacgaagggaaaaaaaaaagtgtttcagggagctgattagaattaggccatctcctaggccctgtataagcacactggggttgagggcaagcctgtagccctagtaaggaaccagagtgcaaggcagggaaaccgaggctgacatgcatcctgtggcctggctcagtggagtgaaggggaagaagagaggctcagggacaggtgttgtattcgctgaattgctgccttacaaatcaccctaaaattcagtgcttaatacagtaagcatttatcattgctcatcggtcagctgagcagctcttctggtcctagctcagctcatttttatgtctgtgatcagctgtgggttgggcaggcagctctgtggatcttggctggatatcagccaggcgaaataagatcatcctatatcacaccataggcacatgtctttgggggttggctggccttacactggtgtagaatagccttgaccaggtcagctggtctctcttccacattgtcggtcgtcatccagcaggctagcttgggctagttctcaaggcagtttccaggacccatgcatgcaggtctctggaggcctaagctcagaattgacccaatatcacttctgctggattctactggcccagcttcatgagatggagaagagattgcttctaatgattggacgagctccaagtcacattgcaagggagttgcacccaggctggggtggagaattggggccatttttattaatctactatgagcataattgggaggctacttgggggcccagggtaccaagattactgagccatgggcagccaatgaactgcagacctcaccagatgctgcaactaaagctgctagtagatatctgttctcctttggattcaccctggagctttggtgaagatgggcctctaagtggcacgaaacagcacctgttccttcaggggagggagcagggacagacgtgtagaactgattgcagaaatgaataacccaggttatagaatatagcctactttgcctggagtttgcatctttctggtaagtttctagtgcttatcaagatttacattaaacagtgtataggataataactaataatctatagcagaacctgacgacaacagtgcgaatagttaccatttgcagcctctgtgaatttcctccaggctgcatctgagtagaggaggtggcgatgttctcacgggctcctatattacaccgtgggcacacagcacatgttacaggctccattcattaagaagttgagcatgcggtttccccaaagagttttacccaagaagacaaagtactttatgaataagttctatggtttctctccttattacattttttgtgtggcatatcacccaatgggctcagtaatttaaacctgacgtttggtctaacaaatggcctacaaataatttcattaacacagttaaaacttttcagaagcaaatctccacaagttgtaagaattccaaagcaaaccctaaatcaagcatggactatgaatgcgttttagatttattccagaaaaagggtccattttaattgctagtctttgtttacatttcacactcggctgcagagctcagtatgctcaatactggagtttcgctcatttcagaatgccttactttcattcacatttccaatgttataataaattacatgtctgtataaatttgcagttttcaagacatttcgtagacattaacacatttgactcttcctagaattcagtggggtaggaagagaggcactgatgttctcatgtgacacacaaggaaaccgagactcaaagatgaagtcacttgttcaaagtccctttcccgagcagacgtccttcctggattccccccgttaacctctctgtatcctgctcggtatggtggtgtatctttgacctcctgccattttatccaatatttcctagcagtgtggcctcaggcgagtcactcaacctctctggacctcagtgtccttcctcatctgtcaggtgaggacatgaccacaatgttcctcatcaggccgtgtgattcctcgagttgacacacaggaagtgctcacagcagagccaggaacacagcaagtgctcaacaaatgcggctatttttaccgttatcactgccaatattagcagcatgctgctggccagggcaaactcagccccacagggtgggcacccctggagcccccaagcctgaaaggagggagtgtgcggagtgggcctgtgctctccagtcctcattttcagcctgtgaagccgcagccactgtggtgacccgggcagttagaaattgtgctttctcttcgtttctaaggaaatcagcttcctgaagctaaacagtgattagaacagtcctgtttcatggttgcctttgagagccatatgacccttcagtggcttcggcagtcgctggctgcccctgttgggacacgtctctgctgggacacacccctgctggagaacctggacttgtgggcaggcagagccttcctgcagacctggcccttcccatgggggctgtgctcgagaaggctgcatgcctctccaggtcccaggggaagcagcaaggggcctccggggcccctgccagctcttaacacacaccagatggacagcccgctgaccacgctcttctcagtggagagccgggtgggaactgtgccaggggatgccgccccaactctgcacagcaggtctcctctcgcccccggcctctgcacgggtgactcagtgtggtccacacacagccaacattctcccaggtggctcaagaatcaaatacagcttattttatgtatagctcaaggtgatttctcagcctcctgcctcccatcccactttatgtccaaagaaggcttagtccattgggcagccttctgcctgctctgcagacacgcctctggcaaattccatcaagacgctactgcttctgtctcagggttagcactgggctctccttgcctaagtcctggggggtttgaaagatcctgtgtgccctacagcagccctgtcctgccaccccctctggcccaggaggagccccccgccccccgcagagttgctggggaccaccctggaacaagtgacagctgttggaagtgtggtttttcaattttagtttaggagagaaaactgatttccaaatacttgggttcactgtgctgctgaataacaacattcacggcccaggtgcccaccgggaggcacgctgccccgagggctgcaaagccccatgttagcactgcctcccggagctcccacgagccctgactccggccccgagacagaaatgaaagcaacagggcacagcgaataatgctatctttctgcttctgtgacaagtctcaggtgctaaacaaagagaaggacatttcccagatctccaagttagtccacaaaaccgacagctctgatggctcgcagagctctgtattagcgggtgttcaggggaaatacaaaacatcatcgagagcctggtccctgtctaggatttaataatcaaattggagaccagacacacacacccggccaaagaacacctaataacataccatgtggtgactgatactctatatgttgaatgtatctgtagcaaaaggaagaaaaggcaggttttgaaaagaggagcatgggacgggcgcagtggctcacgcctgtaatcccagcactttgggaggccgaggcgggtggatcacctgaggtcaggagtttgagaccagcctgaccaacgtggtgaaaccccctctctactaaaaaaatgcaaaaaattagccaggcatggtggcacatgcctgtaatcccagctactcgggaggctgaggcaagagaatcacttgagcccaggaggcggaggttgcagtgagttgagatcgcaccattgcactccagcctgggcaacgagactgaaactccgtctcaaaaaaaaaaaaaaaaaaaaaaatgaggaaggtgtgaattgaaaatgaggaaagagatcaggagagaaagcagatatatatcacaaacctcttgcttacgtgagaactacggtgtttctcaaggtctcacttgtgaaatggtgggtcacctttttccctctcataagcctggcctgtttaataaactctatgtatacgtgtgtcagcagagggtgagtggagagtttaaagaccttatccgggaccccagaatggcagatgagggaagggaatgaggttcatgagcacactgtgcccccattccagcctgctcctgcctgctctacagacgcattcgctgaaacgtaccacggattagcagaagggtggtttgcagtgcatgtgcataatgctcaggcttgcaaagggcggaaggtcgccaggggttctgagcatctccaaaacttcacgacagaggccaacccacctgggaacacagtgacactgggacccgaagccccaggaaggtgggctcactttcgttgttagtggtgtctccgctgcgaggtccattcacggctcgtgtctcctcttgtgtctgacaggctgaagtgtgtgcaggcaccgtggcagaggtgatccagtctgtggtcaacggggcagatggctgcgtgttctgtttcggccacgccaaactgggttcgtgagagtttcactttctcatgcggctcgttgagctccctgtcatcccatgcattcctctgtctccctcccagagttctctgatgacaggaagggctgcgtttctcttaggtgttgagctgaataaccaataacaagttatacgacgaaaacctatgttgttcattgtaggtggacacccattcatgtaggaaagccttcaagtccaaatagatggaaagagaagtagcagagttgttcccacttggtccaggtcagagtcaagcccagaaggcaggcaggaaaatattcatttcctgagcagccgctgtttgggaagcagatagggccccttgcaccaccgcacccatgaggatgtgggttggtggttggacccctgtaaaagccagaggagcaacctccaagcaaagcccagagcccagggcgcgtctggagaaagcagtgcacaccgtcgggaacactccagcgctgaagcgtctgggaaaggaggcagcagagccccccaacaaggggttcataaatccccccacagtcccatcttacttctgacctgtggccatctgctccccaggccttgcccttacacgcttgatatgtttagtgaattgaggagcttcaaaaactgtcccttggcagagattccaacagaggccttgctggagctcacagaggccagttctcagccaggacagaaagccattgcctctctctgcacttccgtcctccccagccctttctcttgatcttgatgtaagcagtgatctgggttttaatagaatttgctcatgccataaaaatatacacagcatttaacttgagacaggatataaagtgtgaatatgtggacttaatctggggggtaactataaaaagaaccataatgatgatgaaaaagcccagccttcccactgtgtgtaaagcagtgcaggaactggatagcatgtgatatttggggtcctcctcaaggtacatggtgatttaatcttgtcacatgtctgggctcttgctttgtttcttttttttttaagagatggctctcagttgcctgggctggagtacagtggcatgctcatagattactgtaacctccaattcctgggctcaagtgatcctctcgcctcagcttcccaagtagctggggccacaggcatgccccaccacacccagataatttttaaaaatttttcatagaggcagggtctccgtatgttgcccagactggcctggaactcctggcctcaagcaatcctcccatcttggcccccacaaagtgctgaggttacaggcatgagccactgagcccaaccagcattctttattgtagccatttagttagtaataccagaaaatgccttctgttgttgtcaaatactatttctctcatctttttgttccttctcttcccttttccccccttccctgtgcctttcttctatatccttggcatctattttggagactccgtggaatgatgcctggacactgaacctgcttttcttccttccctggttctcccaggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcaggtgattgcttctgaagcctggctcgccccaaggtggctccctccccacctcagaggctggggcagctccacccgtgaatcactgaacctgtaaactcagaggcttacgggtgtttactttaaagtggactggaactttatggcctgcagctgtggggccatcggcttgcccagtctaaatatttgtaccttgactctaattgacaatgagcagggaccacaattacagcatttgggggagaaatggaattcactttctttatgcccctttcaaaaaaaaaaagtaacaatctttcttttgtttaacaacaaaccggaatatttactgctctgcacaaatagctagagccattacggggctgttgatgactctataaactgtgcttctggcactggtttacagccggattagcagtgctgcaggaaaaactaataaccactttctaattagaaccgtgatataattgctagaactatggaagccaagagaagctccagttcaccatttcaggatgctaagcctgttgggagggtctctcctttgctgtttgacaacagatgtaggaatgacccgggagctgcaattcattcatatccagaataatcaatccttccagtctctaacagtaggctttattttcccgtgttgtcagatgcctccttttgtagataggtgttccgtttgataagtacctgcctcttcccaactgggattgtttgcacaggtgaggatacctcccgtggcctgttatactcattactcaaacctgaccatgctcttcccctgcttaaagcacctcagatccctccatttccctgagtcctctttcgtctgcatctgtcacctcgaggacttgtttaaacactgatcgctgggcacccccccagagtttccaattcagtaggtctagagtagagctccaaaatgtgcatttccaacaagttcccatgagatgctcatgctgccggtccagggatcacagttggaaatcactgttctgaggcatcaaatgtgcagagacagtatctacacagtgtctgtgatgcaatcagtaggactcgacccactgctcctgttccaggcattttctagacattcaaatatgctttcacccccattcatttttagaacttcattgatgaaattccactaaggggtgaaaagtctggttaaatgaaggctaagaaaaagaagaaaagaccaatattccctttaattcttgttgaaaaatcttttaaattctttggtttatttttccatagcgagacaaaattttgaacacaaaagaatctctctttgaagtctgaggattttgatggcctcaggttctaaatattggctcttacagttcaaaattatttgtatagttagagtagaaaattgtcagaatttgtaccaaccttaagacatgtactgcaaattagttctttgaacaaatcagaaacatgagttgccttttctccccaaaaagaggagtgctggttcaattctgttaatgtgatcgttgtgattcaggtttaaaataattgccaagtattttcataagattcagacgcattaccctgtgtgctttctttaatcaattaatgagtatgccgggagcatggattcaggaactaaaggtaaataggtatctcctaaatttagatgagacattcaagtatcgtgagtgtttgagggtgccctttacactggtttcttatttataactatgctagtaaatatggcctaaaattggctttaattaaataactgcaaaactaggagtcaaatgaaagctaaccaagtttttttacatctttgggacaccactgctatgaggcctcaaatcacattttgcaacctacctgtctccaaacaatctaatctttggactcaagatgcagtcacatcgctcctgttttcttaggtaaatggatagccaggggtgttggtttgccgccctctgcagagataaggatgagccatctgctcccagcttttcacacccactagttccagattctacttagactgtaaagtaggtaaaaataggtttcatccaataagtatgctcaatattaattttcagaaatgaattaattaagctgagaattgcacatgagcatagcaccttgtttcagaagggttttcagccttagaggggcacgtggctttactatacagaacacacagccagctgaatggtgctggggacacccaggcatgagtgacagcaagccctcctcagcctgcagcctcatctcttggcttctgtcttccagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaagtaagtcggccactccaccctcctgcctccttagcggctctggccccagccagaaatcccttgggcaaccatgacctttgtgtgtgtgtgtgtgtgtgtgtgtgtgtgtgtgtgtgtgtgtgtgtgtgtgagagagagagagagagagagagagacagggtcttgctctgtcacccaggctgcagtgcagtggcacgatcacagctcactgcagcctcaaactcctgggctcaagtgatcctcctgcctcagtctcccaagtagcttgggactacaggctcatgccaccacacctagctatttatttggttatctttgtagagatgggaccttgctatgttgcccaggctggtctagaactcccggtcttgagatcctcttgccttgatctcccaaagtgttgggatgaaaggtatgagccaccatgcctagccaaacttttcttaatagactacaatatgcagttcagtgactcgtaattcaagataattatagtatctgggctgaagttcacttttgaactgtccagggaaaggagtttgctttggtaaaggtaatttacaaatgtcattgccatgagaatgtgagaggtcaaagttacaaaaagaaaacaactgcctgacagtatctttttgttcacagacctcaaaaatgctcctcaagaaagaccaacatttatccaccaaagcactccggcagtgtgttatcatcattagctcgaggccactgtatggaccatgttttttaaaatagcatagaaatcagacttttgaataactacccagaccctggctgcctccctcaaatcgtcagtgaaggtttactgtcaaaacccaggtacggtgcctgctcttcgagtgagctgccctgccaggaacccaacactgtgcccctacagacccctcttggctgtgtttccaaagtcagcccgggctggggtgcaattctctgccttctgtgaagtagtgtttactctatgcccaaaagagttgagcaccagatcagctgaatgtctccagtggggatcttggaccaggggcaaagtggtctgttgatttcactgggttcctaaggcaggttgtgggtaacggggctgctgggctggccgggcagtggcttccgtggttcctccatgtcccgctctgccgggctttcaatacacaggcaactggctcccagcgctttctgcatgattgtctcaaagacactggatgccagaaaaacaatcagaaaactgagttaagagtctaaccctggactggaaattgtaaagctcattgagtaaagcagagatggtccgcaaagctgttgtagatgaagcctagaatgaagacatccaagtaggaccaggcgtggtggctcacacctgtaatcccagcactttggaaggccaaggtggttagatcacttgaggtcagcagtttgagaccagcctggccaacatggagaaaccccgtctctactaaaaataaaaaaattagctgggcgtggtggcacacacctcccagctagttgggggtctgaggcaggagaattgcttgaacccaggaggcggaggttgcagtgagcccagatcgtgccactgcactccagcctgggtgacagagcaaggctctgtctcagaaaataaaaataaaaagacttccagctgggatctatggacaggctccccctgatttcccctaagcctcctcgtggctcaaaagacctggacaacagtactcctggggagagagctctttgcgggcttctgctgtccccaggcaaaagcgcctcccttcccccacctcggtgcctctcttcctactctttagttactgttgttaaaatccaggtttattgcagtataaggtacattcaccaaaacatcactttgatgtgtctttagatgagttttggccaatctatacagtcatgtagccaccaccattatcaaaatagagcataaggctaaagttccctcttgccgtttgtcccttcccctgacctctagcccctggcaaccacggatctgattgttgtcctggttttgcgtttatccaggatatcgtgggaatggactcgtgtggcccagatgtggccttttgtgtctggcttctttcacgtagtgtcctaatgcatttgagactcccccatgctgcagcacgcgtctcttgtttcttctggttcctgctgcctgttctgcctgctcctttagtttttttgtttgtttgagatgaagtctcactcactctgttgcccaggctggagtacagtggcgtgatctcggctcactgcaacctccgcctcccgagttcaagcgattctcctgcctcagcctcctgagtagctgggaatacaggtgcccaccaccatgtctggctaatttttgtacgttaagtagagacggagtttcaccatattggccaggatggtcttgaactcctgacctcgtgatccacccgcctcagcctcccaaagtgttgggattacaggcgtgagccaccgcacctggcctctccttcagttttgactgggcctggaggcttggttcctaccctaccaccaggacagaatgaaaatatccacagctggggctggagttcctctaactggggctgctttttatggctctgaaaatcagccctgagctgcctccagtggctgctgtgaagaaccgagaggttctggtcctcacttacagcgggcgaggcgccccagggaagtggcccattagcttgagggcagctctctcgacagcccatgatggtgagcaaagtctcactggagaggagccgaggatagtgaacgggaatctctcgggagatgtattcttggtaacaggctcacaccatgtagagcgcttccgtttagaatcacgttcttaaagaaggaaacgcattcggatagggatgaggagatgcagacctttaaaatcggatagggatgaggagatgcagacctttaaaatcggatagggatgaggagatgcagacctttaaaatcggatagggatgaggagatgcagacctttaaaatcggatagggatgaggagatgcagacctttaaaatcgacagcacaattgcatccacatttctcctgactgtgtgggagttggccttgaaccctgccctcactgttttctcctgggtagtgtcttcaccctgtcaatgtaagagtctgacaaatgtttagtttattcttttaagcagctgtcagtaatcatcatcatcagagcctgcaggactttcttgtactttcagtaaagagtgactcgcaaaacatctaacccttgagccaaatgactcccaaatggcactgatcagaaaaacttgggagatgggattatctctcctccttccaggtttcaaaccaaactgaggacaactctgttttcggttttgtactttttttcttttttgcagttctgctttcgatttggaatctgaaagtagggagaaatcttgaaaacaaggaaacagttcattaaatgacttcaaatataagaacttgaaattcagattccacaaaagtttaggccaagacattccctaaacccagtgatccaccccaaatcagtacctaaggaatcctgcacccttattaaatatttaatagccagctcatcttcttcctatttttaagttgtgaaagagaattgcttttaaataatgcattcaggttaaaagaaagggcaaataccacgaatggtttccaaaacctcggttaggtccttcctaatgtttcagtggatgagaacaaagaaggggaaggagtccaggggtcgtgcgatcggcagacctgggggacatctcttccctcccgaggggaaaggatcccggccagaatgcacacggcctccccgcctgggactcacttgacttcagtgaatttataactgtttaaaatataatgaggagatttggagggttgtttaaaatggaaattttgtttacttacatataagtaataatccctgcggacctggcagccagaactcaattaggggaaagtttattaattagtcaccctgcagggaagccattagaagagatctctgccgcaagaactaaatagactctgtgtgcgcctctgaatctcatatgcacacatgcattttatacattttacacacaaatgcatcttacatttataattttacacacaaatgcattttacacatataagtagacagacaaaaaaaagttttaaacatttccagtcaaaatagaaaagtctttgttgatgtatccctgttttgcagatagcactaggttaagcttaaaatatctccctgtttaaaagctcattggaattagtgggactgatccttcagcctcatggaggccttcctctgctttgcgaagctaaatctgtaatagcttgagagcctcctcgggaatcccagcactgggaaacagaccctgaagccctactgatcagagagctgcttctcataacgacgcgtgtactgggcacctaaaacaaggtggtgcttgggaccagaagtgtttcagatttcagattgttttccgattttggaatatttgcatatgtaatgatcccttgggaatgggacccaaatctaaatacagatttcatgtatgtttcatatatgccttatagacatagcctgaaggtaactttatacaatatcttcaataattttgtgcatgaaacaaagtttttactgcattttgactgcaacccctcacgaggtcaggtgtggaattttccccttgtggcatcatattggccttcaaaaagtttgagattcttggagtattttggatttcagattttttgggttagggatgctcagcgtggactagtgatacttcagggtaatgcgctaatgatacggagatcgcacctgtcctgttgacaaagataatttcaaaagccccacttttatgagtaatctaagcatgcaagcaactgttgctcaaggtccacaatgacaccgggtctctgatttgttcattctctttattgcctctgtggggaggattagagggctttgtaggctgggctgctgtgtgcgcacacaaatgtatgtgcacatgggcacacatctgtgctacactcatctgtctacacatctcatcagactctttaatctgtttttttgtttgtttgtttgtttgtttgtttttaacactgagtctcgcactgtcacccaggctggagtgcagtggcgcaatctcaactcacttcaacttccacctcctgggttccccgcgattctcctgcctcagcctcctgagtagctgagatgacaggcgtccaccacaacacctggctaatttttgtgttttttagtagagacggggtttcaccatgttggccacgctggtctcgaactcctgacctcaagtgatccacccacctcggcctccccaaagtgctgggattaccatacctagcctaatctgctttcttttgacaatgcaaatgttttctttacatgtcatggaatggcttaaatcaactaatgctgtatttagggctgtgtggtggatatgactctggagatccattctttgggtggcagatgtgggaaaagaggcttaggaaagaaccttgcttctaatggagccacagccagtcccctgctgtccccagcagcgaagccctgtgcagcaaggatgtccacacactacagggctctcatctcccgcttggtcaataatgaagtggcagtttcatctttttaggtttttgtaatctatatgtttttaaatgttggccaggagacactattctgaagagtgcagcctggaattcccatcaccgcctccgtttctaatcttctcaagcctcctggccactctcagcaggtaactagcatcttagtcaatgagaagacagagctgacctggtgcattcctcaacttctcttcttttggtttcatagtctcctggtccctttacctcagtttcccccctgctccttcccacaggcctgctgctcccgtctcctggcattcttcctcctgccccttctgcctcttctgggacctcaccaattgggaccccctcagtggtcttttcatgcttatgttttcagcctttcctcccaccaaagtcagggttacagaaggaagagaaggaggcagggagggagggaaaaggaaaggaaaggaaccacaatggcaccttgcctctgccacgctcctctccgatcgcctcctcaacaaagacgtcagattcccctctttgtaatgtcttctttgaatttcagcagtgtgggggatgttatgcttttgccttactccgccttatattttggctgtttgtgagctagtccaagccctattggactataggtgccttgagaaagagtgccacagtgccagggctgtgtctgctgcatgctgtttgtgagcttgtccaagccctattagactataggttccttgagacagagtgccaccgtcctggggctatgtccgcagcgtcagtatccaaggcctattagactataggttccttgagacagagtgccacagtgctggggctgtgtccgctgcgtcagtgtccaagccctattagactatagggtccttgagacagagtgccacagtgctggggctgtgtctgctgtgtgctgtttgtgagcttgtccaagccctattagactataggttccttgagacagagtgccacactcctggggctgtgtccactgcatcagtgtccaagccctattagactataggttccttgagacagagtgccacagtgctggggctgtgtctgctacgtgctgttggtgagcttgtccaagccctattaaactatgggttccttgagacagactgccacagtgctggtgctgtgtccgctgcatgctgttggtgagcttgtccaagccctattagactataggttccttgagacagagtgccacagtgctggggctgtgtctgctgcgtgctgttggtgagcttgtccaagccctattagactataggttccttgagacagagtgccacagtcctggggctgtgtccactgcatcagtgtccaagccctattagactataggttccttgagacagagtgccacagtgctggggctgtgtccactgcatcagtgtccaagccctattagactataggttccttgagacagagtgccacagtgctggggctgtgtctgctgcgtgctgttggtgagcttgtccaagccctattaaactatgggttccttgagacagactgccacagtgctggggctgtgtctgctgcgtgctgttggtgagcttgtccaagccctattagactatgggttccttgagacagagtgccacagtgctggggctgtgtccgctgcgtcagtgctcaggtctcctttgtccaaatgaaatgtgtgctgtggttttaaaaatgattctctgctctcgaactcctgacctcaggtgatccacccacctcggccagcctggccaacatggtgaaaccccctctttactaaaattacaaaaattagtcaggtgtggtggcaggtgcctataatcccagctacttgggaggctgaggcaggagaattgcttgaactcaggagtcagaggttacagggttgcagtgagccgagatggcgccactgcactccagcctgggcaatagagggaaactgtttcaaaaaaaaaaaaaaaaaaagaatctctgggctgggcgtggtggctcacactgtaatcccagcactttgggaggctgaggccggaggatcacttgaggtcaggagttcaagaccagcgtggccaacgtagtgaaacctcgtctctactaaaaatacaaaaattagccaggcatggtggcgggcgcctgtagtcccagctactcgggaggctgaggcaggagaatcacttgaacctgggaggcggagcttgcagtgagctgagatcacgccactgcactccagcctgggtgacagggcaagactccatctcaaaaacaaaaaatgaaaaataaaataaaaattaatctctgtgttatctagtagagctgtgattcgggaagagtaagaccacccaattacctttcacgtaagcagatggtattaggtcagagaagcctcacaacgcaacagagtcaggaggcagtcagctgactgggcaagtatgttagagggggaattatagaaaatgatgtattcataaaggtgttatctgaaattaaataatacaaatgtatttttattcattgatcttacgaaccacaaagggccaaggctctctctttgagttttcaattcaattaatttgacttccacgaaccacattcgtattaacagttcagtttttgctttgaatttcttcaaagagatttaagagcttaaaaaaacactttacaaccaactgggtatagactttttctagattcttacagtattttccactctataattcctcattcacacaaaattcaacatcgttaaaaaaaatttttttttttgagacagggtctcactctgtcacccaggctgaagtgcagtggcgctatcttggctcactgcaacctctgcctcccaggctcaagtgatcctcccacttcagcctcccacgtagctggggcaacaggtgcgcaccaccatgcctggctaatagtttatatttttttgtagagatggggtttcaccattttgcccaggctgctctcaaactcctgagctcaggcgatccacctgccttggcctcccaaagtgctgggattacaggtgtgagccatggtacccgtccaaaaaatcctcattttttatcacatcttttcaaagcattgagttgagtttttataaaaacattaactctctttacaaaatcatttcattggcttatacagtattttatgtttttatttaaaataacaaggggcagaaaccaatttaggaggaaacacagctgacctattaagaactatgcagctgattctttttggagcaaaagtgcacaaactagaccacagcctccactaaccacgagccctcagcgtgctgtgggcgtcaggcagaacttcttatgcaggtgacccagagcattgctgaacctggccaggtggtaaggcagtggctcccaaacttagctacacattagactcacctggagggcttttaaacgcatcccagagtgcgtgctgccctccagcccaattaaattagaaaggctgggagtgggaaccagacgtcaatatttcttgaaagattccagggtgattccaacgggcagcaaagtttgggaggaactacgacggtgcgggaaggcgagttaaaagagcttctgcatgctttctggttagcttcggattttcatcttagatttagcattaattttctatgagatcttgggtgatttatttaacttctatgagcctcagtttccttatatgtaaaatggggctaatttctgcattgtgggatattataggaattaagtgatattaggagaatttaggatttcctgctaccttccaggtgcttaataaagtgtggctcaggcgtaggagacgttattatattgtttcctgtgggtagaataaggcatgtgggtaatttggtttggtcaaagtctagacttaaaatattgcatattagaatataactaaaggattactcaaggcagactgagttgtgttcctttaaccctgcagtcttgacctcaaaatctggaaagtcagtgaggaacctgcttcttacctgctattaattatcacctattgtgttcatttgctgtgtaactacactttctccccagccgccggaagtgatggaaattcttgataatagcaagtggcctgtgctgactcaccttgtactatttcaagttaagcaccatgtgtgaaattcacaattctgtgcctacggcaactccaataggcacggagcagagagtagattttccattgtctaaatgtgactcttactttgagtcacgcaggtataattataggtattttatattatcatcctcagcacagtctaaactgtgccttttgttcttgtgttctgttttactacatgtacattatccattttattccattacatcaaatggactgttagagtcagaattggtctctgtctttgccctttaatctgtggtgcatgtggaatatctgagcttctcctgtctatataattaggctgcaaaacagatgatattttgctttaaaaataactatttccatagcacgctgctgtgacccaagcttgcagggtacaaaatagcataaaacagaagtgacacattatatcttccccttaaaggggttttactgggaatagttgaagagaaacaaaatataacatccttaatgtaaaaagttctttgccatagacgtgccagtagctggagagctggaattgcaatgctttctttaagtatttctcacctttttttctcagtactagatatggaatttgaggataggaaggggtggaggcagattagccttaggacagtggttgccgaatattttcatcctacagcatgagcagtgctgcatcagccttgtccttcgggctcttctgcagacgcgtggatgcctagatccctcccacgcaccccgagtgccacctgcaatggtccagacacacgcgggtcccacacgctctgctcgctttttgtaccaacacctttcaatcttgccccaaattacttggcctccacaacagctttgggaagtttccatctctgcctttgccattttccttctgtgcagagtagggaaaggcagagggaagagttgctgtcctggcagtaacaggaggcaggccaggtatgaggctgtaagctgggccgcctggaaagatagggatccagaggcctggaggagcagcattccgctgctgcctgggattgaggcggggggaagggagacagccaaggagtgggtgatgtacccagagacacgcctctctggaagagtggggcctggggcaaaaaggcggccttctccggctgcttcgtggagctgatggaggccgcaggatgtagttgagagctcaggtcttgcagtcagtctgtggtttgaatcctagctctactactggctgcaggatcgtgagcaagttttttttttttttttttttttttttgttgttttttaacaactttaatgagatatacctgagctacaataaactgtacatattaaatcatataacttgatgttttatcatatgtatatgcctatgaaaccgtcctcaatcaagataatgaatatattcttcacccccaaaagtttcctcgggagccttgcaatccctgcctccagctcctcttccttcctgtctccagacccaggaaccactgaactactttcagtttctagacattagtgtggatttcctagaattttatgtaaaaggaaacatatcttgcagacggtactctcgtgtgtggcttctttcacttagcataatgattttgagatgtaatcatttcattgcctgtatcaatagttcatatatttatatttctgcataatagtccactgcccagatataccacagttggccgatccattcatctcttgatggacatttctgttgtttccagtttggggatattacaaataaaagtactaaaggttgagcatccctaatctgaaaattcgaaatccgagatgctccaaatctgaaactttgtgagcgccaaatgacatcacaagtagaaaattctacatctgaccgcatgtgacaggtcacaggaaaaactttttgtgtacaaaattatcaaaaatattgtctaagattatcttcaggctgtgtatataaggtatatatgaaacataaatgaatttaatgtttacgttgggtcctatttccaagatatgtcattagatatatgcaaatactccaaaatctctggttccaagcatttcagataagggatattcagcttgtgtgagcatacatgcacaagtctttgtatggttatatggtttggctctgtcctcgcccaaatttcatgttgaattgtaattcccagtgttgggggagggacctggtgggaggtgattacatcatgaggatggatgtcccccatgctgttctcatcatagtgagttatgagatccggtggtttaagagtgtgtggtactctcccccctgctcactcgctctctctcctgctctgccatgggaagatgtgtcttccttcactgtgagtcaatgaaacctattttcctcataaattacccagtctcaggtagttatttatagcagtatgaaaacagtctaatatatatatggacatatattttctttcctttggggtaaaaacctatactagaactggaatcttatcaatgtctgggaatatttgaaaaaaaaaaaaagaaaaactggaatggctgtaccatatagtagatgtttaactttttaagaaatttctcagctgtttcccaaagtgcttgtactattttatatggggagttcccgttcctccatacccccaccagcatttggtgtggtcagtcttttaagttttgcctgtttacatagtaggtttgtaatagtgtcttgtggttttagtttgcacttcgctaatgaccaatgatgccaagcatccttctacacgcccattcggcatccatacctcttctttggtgaaatgtcccttcaaatcttctgtccttttaaaaattgttttgaaagtttttaatatattctggatgcaaatcctttataagatatagtatttgcaaatattttctctcagtctgtggcttctctcttcattctcaacagcatcttttgaaaaacaaatacttgtttttttatgaagtccaatttatatgttcttttatgaatcatgtttttgctgtcacatctaagaaatctttgcctaacccaaggccaaaaaggtttcttcttatgcctcctctagaagttttgtaattttaggcttcaaatttaggtctttgatcaatttttagttaatttttgtatattttgcaatgtatggactcaagtagtttttttcaggttgagggaggttaggtgtttttttgtgtgtgtgtatgaatatagtatccaaaatttccagtatcatttgttgtaaaaagctattatttctctactaaattacctttgtcaaggattagttggccatatttatgtgcaactatttctagactctgttctgttccattgatctatttgtctatctttacaccaataccacactgttttgattatggtggatgtataataggtcttgaaattaggtaatgttaaccttccaactttgttcttattttttaaagttgttttggctattcagtgtatttggcatttccatacaaattttagagtcgctttctaaatggattacgtagaaaaaatttctatcaaagaagtctaccaggattctgattgggattgcattgaagctatagcaacttggagatgattgacctcttcacagtattgagtgttctgacccaggagcacagtatctctctctagtttaggtttttattagttcccttcagtaattttttaaagtaggaaaaagctattatttaaacatgtatttcttttatattgatatataattacacatatttatgggtgatattttgatgcacgcatacaatgtgtgatgatcaatcagggaatttaggagattcatcacctcagttatcacttatttgtgttgggaacatttcattattttcttctagctatttgaaaatatacaataaattattgttaactatagcctcctactgtgctatcaaacactacggcttcctccttttatttaactgtgtatttgtaactgttaacccacctgttttatccccctcccccggcaccccacatcccgccccttcccacacacacacattcttcccagcctctggtatctaccattctcctctctacctgcatgagatcaactttttaagctcccacatatgagtgagaacatgcaatatttgtctttctgtgcctggcttatttgacttaacataatgacatccagttccatccattttgctacaaatgacaggatttgagtttttgtataactactagtattccattgtgtatatagagcacattttgctacaaatgacaggatttgagtttttgtataactgctagtattccattgtgtatacagagcacattttcttggtcccgttccattcatccatccattgttggacacttaggttgattctgtatcttggctgttgcgaatagagctgtgataaatataggggtacaggtatccctttgatatactgatttctgttcctttggacaaacacccagtagtgggattgctagatcatatggtagttctcgttttagtttttttttgagaagcatctatactgttttctatactggctgtactaatttacattcccaccaacagtgtgtaagagttccctttactatgcatcttcactagatttcatggtgggttttttttttctgtctttctaataatagccattctgactggggtgaaattatatctcattgtggttttgatttgcacatccctgatgattagggacattgaacattttttcacatacctggttgccatgtgtatgacttcttttgagaaatgtctattcagatcctttgcccaatttttaatgggtttgtttgggttttttgctgttttgagttccctggatattaattccttgttgaatgaacagcttgcaaatattttttttccattctgcaggttgtctctttgctctgttgattgtttccttagctgtgcagaacgtttttagtttaacatactccaatctttctaattttggttttcttacttgtgctttcaaagtcttagccataaaatctttgcctggaccaatgtcccaaagcatttcccctatgttttcatctggtagagttattgtttttggtcttaatatttaagcctttaataaattttgagtggatttttatatatggtaagagatagcggtctagtttcacccttctgcttatggatatctagttttcccagcaccatttattaaaggggatgtcctttccccaatgcatgttcttggtgcctttgtcaaaaatgagttggctgtaaatagatagatttatctgtaggttctctattgtgtcccattggtctatgtgtctttttacgtcaataccagcctgttttatgttacagtagcttcctagtagtgtattttgaagtcagctagtgtgatgcctccagcttgtttctttgttttccagtattgctttgtgtgcaaggtttttctctgtgtgtttaaattccatgaagaatgtcatggatatttcgacagagactgcattgagtctgtagattgctttgagtaggatggtcattttaacaatgttaacttgaactcaggattcagaaactcactcaaaaccacacaactacatggaaattgaacaacctgctcctgaatgagtcctgggtaaataacaaaattaagggagaaatcaatgagaacaaaaagacgatgtaccagaagctctgggacaccgctaaagcagtgttagagggaaatttatagcactaaacgcccacatcagagagctggaaagatctcagatcgacaccttaacatcacaattaaaagaactagagaagcaagagcaaacaaatccaaaagctagcagaagacaataaataagatcagagcagaactgaaggagttggagatgcgaaaaacccttcaaaatatcaatgaatccaggagccagttttttgaaaaaaaaaattaaggaaatagaccacttcactagactaataaagaagaaaaggagaagaatcaaacagacacaatagaaaatgataaaggggatatcacccctgatcccacagaaatacaaactaccatcagagaatactataaacacctctgtgcaaataaactagaaaatctagaagaaatggataaattcctggacacatacaccctcccaagactaaaccaggaagaagtcaaatccctgaatagaccaataacgagttctgaaattgaggcagtaattaatagcctaccaaccaaaaaaagtccaggaccagatggattcacagccgcattctaccagaggtacgacgaggagctagtaccattccttctgaaactattccaaacaatagaaaaagagggaatcctccctaactcattttatgaggccagcatcatcctgataccaaaacctggcagagacacaacaagaaaaaggaaacttggccgggcacggtggctcacagtggctcatgcccataaccccagcacttaggggagccaagcaggtggatcacttgaggtcaggagttcgagaccagcctgccaacatggcaaaaccctgtctctactaaaattacaaaaatagatgggcatggtggcgggtgcctgtaatcccagctaatcgggaggctgaggcaggagaatcacttgaacctgggaggcagagattgcagttagccaagatgaagtcagcttcatccctggttcaacatgcaaatcaataaacataatccatcacataaacagaaccaatgacaaaaaccacatgattatctcaatagatgcagaaaaggccttcaataaaattcaacacccttcatgcctcaataaactaggtattgatggaacgtttctcaaaataataagagctatttatgacaaacccatagccaatatcataatgggcaaaagctggaagcattccctttgaaaaccagcacaagacaaggatgccctctctcagcactcctattcaacatagtgttagaagttctggccagggcaatcagacaagaggaagaaataaagcatattcaaataggaagagaggaagtcaacttgtctctgtttgcagttgacctgattctatatttagaaaactatatcattggagcccaaaaacttcttgaactgataagcaacttcagcaaattctcaggatacaaaatcaatgcaaaaatcacaagcattcctatacaccaacaacagacaaacagagagccaaatcatgaatgaactcccattcaccatcgctacaaagagaataaaatacccaggaataccttacaaggaatgcgaaggaccccttcaaggagaactacaaacaactgctcaaggaaataagagaggacacaaacaaatggaaaaacatctcatcctcatggataggaagaatcaatatcgtgaaaatggccatactgccaaaataatttatagatccagtgctattcccatcaaactacactgacagtcttcacagaattagaaaaagctactttaaatttcatatgaaaccaaaaaagagcccatatagcaaagacaatcctaatcaaaaagaacaaagctgggaggcatcacgctacctgacttcaaactatactacaaggctacagtaaccaaaacaacatggtactggtaccaaaacagacatatagaccaatggaacagaacagagacctcagaaataacactacacatctacaacaatctgatcttcgacaaacctgacaaaaacaagcaatggagaaagaactccctatttaataaatggtactgggaaaagctagccgtatgcagaaaactaaaactggaccccttccttacaccttataaaaaaattaactcaagatggattaaagacttaaatgtaaaacccaaaaccataaaaaccctagaagaaaacctaggcactaccagccaggacataggcagaggcaaagacttcatgaagaaaacaccaaaagcaattgccaacaaaagccacaattgacaaatgggatctaattaagttaaagagctcctgcacagcaaaagaaactagcatcagagtgaacagacaacctacaaaacgggagaaagtttttgcaatctatccatctgacaagggtctaatatccagaatctacaaggaacctaaatttacaagaaaaacaaacatcaaaaagtgggcaaaggatatggagagacacttctcaaaagaagacatttatgtggccaacaaacatgaaagaaagctcaacatcactgatcattagagaaatgcaaatcaaaatgacaatgtgataccatctcatgccagtcagaatggtgattattaaaaagtcaagaaacaatagatggtggcaaggctgtggagaaatagaaacgctttcacattgttggtgggaatgtaaattagttcaacttctgtggaagacagtgtggtgattcttcaaggatctagaaccagaaataccatttgacccagcaatcccattactgggtatatacccaaaggaatataaatcattctactacaaagacacatgcacacatatatttattgcagcactatttacaatagcagagacatggaaccaacccaaatgtccatcaatgatagactgcatgaagaaaatgtaatacatatgcaccatggaatactatgcagccataaaaaagaatgagatcatgtcctttgcagggacatggatgaagctggaagccgtcatcctcagcaaactaacacaggaacagaaaaccaaacaccacacgttgtcactcataagcgggagttgaacaatgagaacacatggacacaaggaggggaacaacacacaccagggcctgtcagggggttgagggaaaggggagtgagagcattaggacaaatacctaatgcatgtggggcttaaaacctagatgacagtttgatgggtacagcaagccaccatagtacatggataactatataacaaaactgcaggttctgcacatgtatcccagaacttgaagtaaataaataaataaataaataatattaactcttctgatccatgagcatgggatgtcttttcatttttttctatgttcttcaatttttttatcagtattttgaagtttttgttatagaggtatttcacctccttacatttattcctaggtattttttagtagctacagtagatggggtagctttcttggtttctttttcaactatttgttgctggtgtgtagaaacactactgatttttgtatccagccacattaccaaatttatcagttctcagagtttttggtggaatctttaggttgttctaattattatatgccatctgcagagaggaacaatttgactttcgcttttccagtttggatgccttttatttctttctcttgcctaattgctctagctaggacttccagtactatgttgaataacagtggtggaagtgggcatccttgtcttgttccagttcttagaaaaaaaaggcttttagcttttccccacttattatgatgttagctgtgggtttgtcatatatgacctttgctatgctgaggcatgttttttctatgcctaacttattgagagtttttatcatgaaggatgttagattttatcaaatatttttcctgtgtctattgagatgatcttgttgttttagtctctcatatgttgatgtgatgtgcacgtttattgatttgcatacatcgaaccatcattgcatccctaggataaatcccacttgattatggtgtattatgttattggtgtgttgttagatttggttcgctagtattttttagatgatttttgcatctatgttcatcagggatattggtatctcattttggtattaggataatggtggcctggttgcgtgaattaggaagacttcccgcctcttcaatttttggaatagtttgagaagaattggttttactttactccttaattctactgaacttttaaagtcctgggcttttctttgttggggaactttttattactgattaattcttgttactcattatttgttcagatttttttattcttcctgatttaatcttgtaaggctgtatgtgtccaagagtttatccatttcacctgagctttccaatttgttcgtgtgtagttcttcataagactctaatcatttgtatttctgtggtatttttttcatttctcattttttaaaatttggatcttttttcttggttagtctaacagtttaatcaattttggttcctttcaaaaatcaagcttttattttcttgatcctttgtaatttttgtgtgtgtgtgtgtttatttcgtctctgatctttattctttcttctgatttttggctcagtttgctttggcttttttagttccttgagatgcatcattcggttgtctatttgaaatctttctccttttttgaggaaaacatttattactctaaacccctcttactactgcttttgttgtatcccgtaggtttaggaatggtgtttttccattttcatttgttttaagaaaaaagattttatttcattcatttaggagcatgttttcatgtaggagcatggttttaaattttcatttatttgtacagtttctaaagttcttgttattgatttcgttttactgaattgtgatctaagatgcttgatatgatttcaacttttaaaaatgtgttgagagttattttgtggtctaacacatggtctatcatggagaatattccatgtactgataataaggttgtgtattttgcagcacttgaatgaaatgctctctaaatatctgttcgatccatttggtctgtagtgcggattaagttcaatgtttctttattgattttctgtctagttgatctgtccagtgctaaagcggagtggtggaccaggaccaggcacattggctcacacctgtaatcccagcactttggaaggccaaggcgggccaatcacttgagctcaggagtttgagaccagcctgggcaacatggtgaaactctgtctctagaaaaaatacaaaaactagctgggtgtggtggcatgcacctgtagtgccagctactccggaggccaaggtggaaggatcgtttgagcctgggagattgaggctgcagtgagccaagatcacaccactgctctccagcctgggtgacagagtgagaccccataccaaaaaataataaataataaaatggagtggtggaggcctcaactattactgcattggggtcaagctctttagctctaatgataattgttttatataatatatctgggtactccagtgttgactgcatatatatttacaattgttatagtctcctgctgaattgttccctttatcattatattaatataatgaccttatttgtcactttttatgttttttggctaacattgtattttgtcttatgtaagtatagctactctggcacacttttggtttctattttcatggaataattttttccatcccttcattttcattctatgtgcatctttacaaatgaaatgcatttgttggagacagcatacagttgggtcttttttttttttttaaataaatccattcatcttgtctatattttttacttaaggaatttaaactgtttacattcaaggatgtcattgataggtaaggacttacttctgtgattttgtaaactgttttatgatggttttgtatattttttgttcctttcttcctcttgtattgcttaccttgatgatttggtagtttattgtagtgatgtttgactcctttctctttctcattcgtgtatctgctctcccagtgagtttttcagtcttgcgtattctcacggtggtagttattgtccttttgcttccagatgtagaactccctcaagcatttctcacagggcctgtctagtggtggtgaattccctccattttttcttgtttgggaaagactttacttttcattcattttttaaggatagctttcagcaatatttcatctttttttaaggatagctttcagcaatattttatggtttttatgtacacattttaatcatatctctaaatcatgtgtttgatgttgttgtaaatggtatttttaattttttttgagttggggtgacagagtgacacccaggctggattgtagaggcacagtcatagctcactgcagcctcaaatttgtagtgttcctgccacctcagcctcctgagtagctaggattataggcacatgacatcatacccagctaatttctttttgtatcatttttctgtagagatggggtctcactatgttgaccaggctggtcttgaactcctggccttaagtgatccttctgccttggcctcccaaaatgctgggattaccggtgcgaggcaccacacccagccttatgttttaatttctaattgtttgttactatgataaagaaatgcattgatttttgtccattgacctcatatcctgcaaccttcctaaactcacctattagttctagtaccttttttgtggattgcatccattagatttttctataggtgactatatcaccaatgaagatcatttgactttctttccaatctggatatcgttcatttattgtacttgccttattgtactggccaggacttccagtataatgttaaatggaaacggtgagagtggacatgcttgtcttgctcccaatcttagagggaaggcatttagtcttttaccattaagtatgatgttagctttagtttttagtagataccttttattaaattgaggatattgccttctacttatatattgctgaggattttttatcaggaatgactgaattttggtaaatgctttttctgcatctactgaaacaatcatatagttttcctttcagtttgttaatatggtaaattatattgattaggttttttttgttaatcaaccttgcattcctgaaataaacctcacttgctcatggtataaaaccctttgtatttgttgctagatacaatatttttttgagttggggtctcactctgtcacccaggctggagtgtagtggcatgatcacagctcactgcaattttaaactcctgtgctccagcaatccttccttccatctcagcctcccaactagctaggattacagtgtgcaccactgtgcccagctaattttttatactttttttgtagtgatgaggtcttgctatgttgccctggctggtcttgaacttcgggcctgaagcacctcagcctcccataatactgagattgtaggagtaagccaccatgcctagccctagatacaattttctaatatggctctttaatattttatttagaatttttttggcaatgttcatgagggatattgttctgcaggtttttgtgtttttttttttttttcaaacaacatacttgtttgcttttggtatcagattagtatagtatagcttgggaagtatttcttcctattttcaggaagactttgagtagaactgttattatttcttccttaaatggtgggtagaattcaccagtgcctccatctggtcctagagttttacctgtggaaaggttgtgaactacagattctatttctttaatgaatctagggccatttttattatctattacctcttgaaagagctttggaatttttcatctttcaagacatttttccattcttacacattgtttaatttactggcataatgtttctttattatctttttgatatctgtaggaactttagatgaggccatctcattcctgatattgatcatttgtgtctttctttttcccagatcatttgtgctagggatttacaaattttgttgatcttctcaaagaaccaacttttgattcatcgacttttctccattgtttttggttttctgtttcgttgatttctgctattttttttcctttctgctatttttttttcctttctgctattattttgtctataatttgctcatctttttctaatttcttaaggtgtaagctgagatcattgatttgaagccatggttgctttctgatataggcatttaatgctatacgtttgttttaagtacatcttcagggttattcacaaatttggatgggttgcattttcatttctattcacttaaaaagactttaaaattttcattttgaatttttccttgaccataggctgtttggggccaagttgtggagtttcagaatatttggaggtttttcagatattgttctacattgacttctaatttaattccattgtatcaggcaacatgctttgagtgacatgaatccttaacatttatttagacttgttctgtggaccagaatactgtgtatcttggtaaatgctttgtgtgcacttcaaaagaatgtgtattctgctattgttgggttgaatgttctgtgtcaagtagatatttgatagtattgttcaaatttatatccttatggttttctgtctacttgtcatatcagttttgagatgggggtatttgaaattgccaactataattaaagacttgtctgtttcttcatgcagttctaccagattgttcttcatggattagaacatgagccacataaatttttttattatgacctcttgatgaattatctcatttctcattatagaacgtttttttttttgactctaacaacatttttcatcttcagtcttttttggcatttttaaattgtgtgtcatagttgtacatatttttggagtacacatgatattttgatgcatgtatacaatgtgtagtgatcaaattaggaaaattgggatattcatcacctcaaacatttatctttgctttgtgttgggaatgtttattattaactatagttcttctactgtactattgaatactaaaactcattccttttatctaactgtatgtttgtacctgctaaccaatttctctttatcctaccctctgcccttcccttcccagcctctggtagccactcttctactctctatctccatgagatccactgttgtagctcccacatatgagtgacaacatgggatatttgtctttccatacctgacttatttcatttaacataatgacttccagcttcatccatgttgcttaaaatgacaggatttcattatttttatggctgaataatattccattgtgtgtgtgtgtgtgtgtgtgtatctatctcacattttctttattaatttacccattgatggacacttagactgattctatattttggctattgtgaatagtgctacaataaacatggtagtgcagatacctctttgatatactgatttcttttactttggatatatactcagcagtgggattgctggatcatacagtagttctacttttaagttttttgagaaacctccagaatgttttccatgatggctgtactaatttacattcccaccaagtgtatgagcattcaccatttcctgcatcctctccagcatttgttttttgtctttttgataatagccattgtaactgaggtgagatgatagctcgttatggttttgatttgcactttcctgatgattagtgatgttgaacatcttttcacatacctcttggccacttgtgtgtcttcttctgataaatgtctattcaggtcttttgctcattttaaattggattatctggggggttttggcccattgagttgtttgaattcctcatatattctggttattaatcccttgtcaaataatttgcaaatattttctcccattccatatgtaggttatcttttcactttgttgtttcctgttctgtgtagaagctttttagcttgatgtaatcccacttgtctatttttgcttttattgcctatgtttttgaggtcttaccccaaaaatattcgccaatgtcctgtagtatctccccagtgttttctcccagcagtttcatagtttcaggtttaaatttaagtccattttgagttgattttcataatgtgataaaaaatgaagctctagtttcattcttctgcatatgaatatccagttttcccagcaccatttattaaagagattgtcttttccccaatgtatgttattggtgcctttgtcaaaaatgagttggctgtaagtgcatagatttatttctgggttttctattgtattccattggtcttctatgtgtctgtttttatgccagtggtatactctttgcttactatagcttgtagtataatttgaaatcagatagtatgatgtttccagcctggttatttttggtcagtattgatttatctactacgggttttttgtgattctataagaattttaagatttcttttttctatttctgtgaagaatgtcatgagtattttgatagggattgcagtgaatctgtagattgctttgggtagtatagacattttaataatattaattcttctttgagcatgggatatttttccatttatgtgctcttcaatatctttcattggtgttttataatttttcttgtagagatctttcacttctttggttgaatttttactaggtatgtttttgtagctgttgtgattgctttcttgatttcctttcagattgatcacagatagcatatagaaatgttacacattttgcgtgtttattttatatcctgcaactttattaaactcatttatcagttctaaaagttttttggtggaatctttagatttttctaaatataagatcatgtcatctacaaacaagaataatttgacttcttcctttctaatttggatgccctttatttctttctcttgccctattgtgctggctaggaattctagtactatactgaataattacagtttatagttcaccactgagcatccttttcttattccagatcttagtgaaaggttttctattttaacctattcagtatgacataagctgtgagtgtgtaatatatgacacttatcttgttgaggtatgttccttctataaatttgttgaggattttcatcacgaagggatattgaattttactgactacctttccagcatctattgaagtaattcatatattttccttgattctgttgatgtgtgatgtattaaacttatttgacttacatatgttgaactatccttgcatcactgggatgaatcctacttgattatggtgaatggtctttttaatatattgctgtcttctgtttattggtattttgttgaggatttttccctctttttatcagaaatattgtcctgtagttttcttttgttatctttggctttggaaataaggtcagggtggccttgtagaatgagtttggaagtatttcctcctcttcaattgttaaaaatagtttgagtagaattggtattagttattctttaaatgtttggtagatttcagcagtaaatccatcagttccctggcttctctttgatgggagactttttattactgttccaatctattacttgttattggcctattcaggtttttatttcttcacagttgagttttggtaggttatatgtttccaggaatttttccattttttcctagattttccaatttattggcatatagttattcataatggtcgctaatgatcctttgtgtatctgtagtatcagttgtaatgtcatctttttcatctctgattttatttagttgggtcttctgttttttcttagtctaactgaaggttttaaaattttgttgcttttcaaaaaaacaaactttttattttgttggggttttttgtattgttattttagtctcaatttcatttatttctgctccatctttactcatttttttcctactaattttaggtttggtttgtttttccttttctagttcattgaggtgcaacattaggttgtttatatttggagtctatatttttaatgtaggtatttattgctatagaactttccattagtgctactttttctgtatcccgtgggttctggcatattgtatttccattttcatttgtttcaagaactttttaaacttcattcttaatttcttcattgacccattgatcatccaggagcatgttattcaatttccatatatttgaatagtttccaacatttcttgttatttatagttttattctgttgtggttagaaaagatacttgatatgattttgactttttaaaacttgttgagacatgttttgtggcctatcatatggtctgtcctggagaatgttccatgtactgatgagaagaatgtgtattttgtagcagttggatcaaatgttctgtgaatatctgttaggtccctttggtctagagtatagtttaattctgaggtttctttgttgatttttctgcctgaatgatccacctattgccaaaagtgaggtgttgaagtcccttactgttattgtattgtagtctacctctcctgtttagatctactaatatttgctctctctctctctctctctctatatatatatatatataccctgctatttggttatatatattcataattgttatatcctctttcagaattgactccttgctgaattattatataacaatttcctttgtttctttatatagtttttcacttaaagtctattttatctgatcgaagtatagctagtcttgatcatttttggtttccatttgtatggaatgcttttggtttccatttgcatggaatgcttttcccatcccttcactgttagtctatgtgtgtctctataggtgaagttagtttattgtaggcaacatatacttgggtcttacttattaatccattcagccactccatgtcttttatttggagaatttagtccatatacattccatgttattattgataggtaaggccttcctactgccattttattacttattttctagttgttatatagtgtacctccttacttcctttcttatttttgtggttaagtgattttctttgatagcatgttttaatttgctgcttttattttttgtttatcaattatagatttttgctttaggttaccatgaagcttacaaaaacatcctgtaattataacaagttatttaaaagtgataccaatttaacttttcattgtagcagaagaaaagaaacaaaaagaaaaaaacacatgcattttaattcccttctgttcctacattttaaatttttgatgtcacaagatcaaaatttgcctacctcaaaaattttatagttgttatttttaatagttttgtcttttaatcttcttaataaaattttaaatggtttagatgccatgattacaatataacaatcacattagcattatttttcctatgcttttaagaacttctttagcatttatcataggctaggtctggtagtgatacgttttctctggaaaactcatctctccttcatttctgaggaataactgcttggtgcagtatccttggggaacattttttttttccttcagcactttgaataatatcatctcactccctcctgacctgtaaaatttctgctgagaagtctgctgccaggtgtatttgatgtccgttgtatgttatttgcttttttcttgctctctcactgtttttaggaccctctttgcctttgacctttgtgagtttaattataatatgtcttggggtcttctcacttgggttgaatctgatcggtgacttttgacctttgtgtacctgaatatttatatttttctccaggtttggaaagttctgtgttatttctttgaataagcttgcaacttcttgtctttctcagttctctctttaattccactaacccaaatatttgctcttttgatgttggtccataggtcccataagctttgttcattccttcttattcttttttttctcttctgactgtctattttcaaatagtcttgtctttgagctcactgatcctttcttctttttgatcaattcctctgatacgctctattgcatttttcatttcatttattgaattttttacctccaggatttctgtttaattttattttttaaatcttttctgtgaactttctctgagagatttctgtgagctttcttgaagttcactgagcttccttaaaactgctattttgaattatttgtctgagagatcacatattttcatcactttagggccagtcttggtgccttactttgtccctttgacatcatatttccctgaatgttcttgacgcttgaagtatgatgatatctacacattgagagattaaatattttagtcttcctagtctggctttgtttgtgcctgtacttcttcagagggtcttccagagattctaagccaactgactattgtgttccctgtgatcaccacagtaatctcagcattagaggatactctattccctggcttgctgtgagtctcacaatggctttctggcccaaacggacctggggaagacccaatgacggtacttgtgttatgtgggaacactggccaccagggacctgagtcctgaagactgtcctagtttcccagacaagtctacttcccagcaggtctctgcacaggtaggttgtgtccccaactatagcaagaggggcagaagttgagactggaccccttcagaatctgctgtgggaaggaggctgatgggcctttctcattggctgagacaggcatgtgttactcagcaagtctctgcacaagtggagtagtttcttgcccataacaggaggagctaaagccaagactgggcctcctcagggtctgctataagatggagggtggccgggtgcctgtagtcctagctactcgggaggctgaggcaggagaatggcatgaacccaggaggcagagttttcagtgagccgtgattgcaacactgcactccagcctgggggacagagcgagactccgtctcagaaaaaaaaaaaaaaaaaaaaaaaaaaatggaggctggcatacctgccacattggctcaaatgggcatgcatcttctagtaagtccctgcatagacaggatagttccccaactatcagcaggaggagctggagcagaatctgggccctcataagatctgctgtgagacagatactgaaggggtcagtctcagctcagaggggtgtgtgtcacccagcaagttcctgtagagatagaatagttatctgattacagagagagggtctggagctgtgactgggccctcttgggatctgctgtggaatagaagctggagagcccagtcttgtatcagaaggcatgtctttcccaggaggacactgcatcaataggatagttccacgactgcagcaggaggtgctgtacatgcctctctgcgggtcttagcacaaatgggataggtctttgactgtcttcagtctcttttgtctaatattggtagatccactccagctcttatggttactgtttgccttatccacacttacacgtttaaatgattgtttatttctatttgaagtgtatttctcaagcatatagtagagcctcacttttttatccaatctgacgatttttgccttttaataagggtattttagactatttcaatttcatatgattattgatatggtttggttcaaaatattattttctgttttctatttgtcccatctgatctttgttctctctctctcttttttgctttcttttggatttatgaaacatttaaatggttccaatttccatcttctgtgggtttattagctattacttttattgtttaattattgctttagtgtttgtaatatatatgtttaagttaccacagtctaatttaaagtgatattataccacttatataaggaataaaaaccttacaatagtatacttccatttctcccgtctgacttttgtgttattgctatcaaacattttaattttacatatgtcatcattcacacgttacattatgatttttgttttaataataatcttttaaagagatttaaagtaataaaaattacatatttacccatgtggttatcatttccaaagctcttcattcctttgtctatattccttgtgtttttgcttatggtgaattcttttaggatttttaagtcaaaaaatatctttatttcccttttgttttggaatgatacttttgctgggtgtatatttctaacttgacagtttttagtactttaaaaacattgctccactgtcttctcacctgtatttccaatgagaaatctgccgtcatccttatctttgttcctttatatgtaacgtgcttttttctctctggctcttttcaagatttttctttatatcactggttttgggcggtttggttatgatgtgccttgatatagtttcttcctttgtgcttggggctcacttagcttcttggatacatgggtttatgactttcattaaatgtggggaagttttagccattatttttctcaaatattttatttgtaccacactctgtcttctcctttagggactccaattacacatagcaggcacttgaagttgtcctacagctcttttttttctgtgttttatttgttgttttttttccctatatattttattctgaatagttttattgctagatcttcaaatttgctgatttttcattctgcaatatctaatctgccattcatctcatctactatattttttttatctcacacattgtagtttttatctctagaggttcagttttgtgtctttttaaatatatattccatgtttctacttaactttttgaacatctgaaatacagttgaaataactgttttaataaatagctgcttctgtcaattctaacatctatgctagttctaggttggtttcagttatctcttcattatgggtttcattttcccgagtctttactttgtaaatattcttaagctttgttttagaatgcagttgcattacttggaaacagtttgatcatttttttgttttgcttttaatatgtgttaggtgggatcaggtcagtgttcagtctgtggctaagtatgggaaagacttctgggtattcaacccaatgccctgtgaattgtgaagttttccaggctggctgttaggaagtggcactattcctggctttgtgtgagtgctgtgcaccattatctccaatctttttaggtagttaatttctgagccttgaatagttttctcacatgaatgttgtgttagtcccttttgcattgctgtaaaagacacctgaggctgggtgatttataaagaggcttattctgctcacagttctgcaagctatacaagaagcatggcacccagcatctgcttctggtgaggactcaggaagcttacgatgatggtggaaggtgaaaggagagtaggcgtgtcacatggcaagagagagcaggagagagaagggggaaggtgccagcatcttttaaacaactagcttttgcatgaagttaaagagcaagaactcactcattaccatgggaagggcactaagctgttcatgagggatccacccccaagacccaaacacctcccaccaggccccatctccaacactgaagatcacacttcaacacgacgcctgtgattctcagtgttggaacctgctgggaggtgtttgggtcatgggggtggacgacacatctccaacattgaggatcacatttcaacatgagatttggaggacacaaacatccaaactacatcaggtgtgctgatcagtactcagctgaacacttgagggaccttctgcaaatctctagagctctctcctctgcagtactctgtcttgtaaattgttgccaccttggtctccctgtacttcagcagcagaggtattcatgggcaagttgcttaagttttctgaacagttattttctcatcaatacagaaaggataatagtatttagcttatgattctactgtgggaactgaacgaaactgatgtttgtacagcacctggcacttggcagatactcagcaaatatttgggtcttccctgtctctgcacctggtcgttacttcttcctgatttttgtcttgggtttgcaacctgattcctggctgagctttaggttggtttctgtataacgatcaaccaaagcaggtaatcactcatgagccattcaggttttaacttgatgagtttcagaattctgctattcaaatggcatttaggtagaaacgtatcctcctgtaatttgacatttattttctccaaaatctcattcagttcaacctgcaagaattatttgaattcacttatttgtagtgtgaatgtcagtaggctttagaaggtcagtggtgcgtggtggaaagaatttaagaggaccaatgctatttgcaaccccagcgtgatttttctggggtttcctagtaggtcatgaacgtcaaccttttacttccccttctcattttgcctcagatttcccaaggagctacatgaagaacagatgagtgtttgtcagaacttaaccatttctcttttatcttctcccctgtggtagtgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaagtaagtgactcttctactcaaagaatgtggtggggtaagcatggtgtgggacgctttgttcagtgccatctgtggagaggtgtgccacagagggacagcctggaccccattataagttcagtgccagagaccagccttagctaacagttgtgtaatgcatgatctcccaaattcaaaacttttggaaatacttaaatctattccagttctaactttaggctgctcaaattagaggaaataggaaattatctcagttgaggtctccactcgcaaatgaaggtggtgggtcattgtcaccataataaagatgtgcctgtttcatagtgatgagagtgaggggtggaagactggcttatccttaggggtagggccaccagacttaaccaaaaaaatataggatatccaggcaaattcaaatttcagataaccaacaaataaggttgtattataagtatgcaccccaacattgcatgggacgctcctggtgacatgtattttatctggcaacccaatctcgggagttcagaaagctaggggagttagcacctgccttcccatgcaaatgtttagtcacttccaggatccttcctgtctctttactactgctccaattaaattacagccgctcctatgtctggcagagacaaagccactccaccaccatcaccccaactaagcgttctcattggaccgtgtggtggcaggccattgactggctgtccaggcttctgccaaggcctagctgagcctcttactagctgcatgaaccttcattcttcctaaaatgagggttaaagctatacatgttacatcacagaaatataaggctcaaaatgataaaacatgtataaaagtttattgtaggctgggtgcggtggctcatgcctgtaatcctggcactttgggaggccgaggcgggtggatcacaaggtcaggagattgagaccatcctggctaacacggtgaaaccccatctctactaaaaatacaaaaaattagctgggcgtggtggtgggcacctgtagtcccagctactcaggaggctgaggcaggagaatggcatgaaaccaggaggcggagcttgcagtgagccaagatcacgccactgcactccagcctgggcaacagagcgagactccttctcaaaaaaaaaaaaaaaaaaagaaaaaaaagaaaatttattgtagaatttaggacactatggccaataaccaatgatgaaagtctggttacacctatctagtcaagcctatcctcacctatttaaagggaaaaaacaccgaccttacagagttgccatgaggtgaagattaactaaatatatgtggattcatggttttatctgtaaaaaccctacaaaacctacgttgctgttgtgtaggaggaaaaagtcgggcagtgtattctataattactgagattcacaatgagtgctggagtttttcttcccctcagccctatgttgatgccagacccccccaccaaatacattgtgagtttatttcctaccaggagaaccattactggactgactttaggagcttaaatggtgattataatcctgtccatctcatttctagaaatttggaatcctagttggataaacccagaaatggttttcccggctcttgtaacaacccttttctatgggagaatattctgagttgaagaattatagagtttcattcgatgtcatttctgtagttgagtaaattcagcttgtggggagaaagggcaggggagggaaaccgttggagttggagatgaagggaagagtactagcactcactggtttccataaaatgagaatcatgtctgttaatgtcagaacttcatagatcatgatatagataaaattccaaattgcaccttagcaggaggtcattgattacatatcttacttatagcttttacactgtttctgcagggcgacatgcttttatgatttctataaatagttgttgaattgatggcgggaagatagatgcatgtaaacatgaaattatttttaatttaaagtaacttccttttagttagagttgggttttttataaatgagtagggaaacattaaaaattgtttttatggcccagcgtggtggctcacacctatattcctggcactttgggaggctgaggcgggaggattgcttgagaccagcctgggcagcatggcaaaaacctgtctctacaaaaaatacaaaaattaaccgggcatggtgttgcatggttgtagtcccagctacttgggaggctgaggtggaagggtggcttgagtccaggaggcagaggctgcagtgagttgagattgcgctactgcaccagcctgggcaacagagtgagaccctgtctcaaaaaaaaaaaaataaatgaaagtttgtattaatcgttcaagcttcgtgttaattaagcatatttttaacatgctggccctaccaactggctacctgccctcctgggagacatctccactcaccagtccctgcagacagctgcctgccttcattccaggagtccccttccttctattctggcaccaagagagtgatcattaaagtgtttctgtgtctcaagtaagcagactagcttccatgcagtgtcagcacaagacccaatcctggagctgtcccgtggcctggttgagctgttgatggcgtgggtacagactcaccagctgcccttgccctgccctgcctaacacaactcatcgagaccttgctgggttgcctggtgctggaaacacggtggccctggccatccagccagcgctgtccttcccaaaacatccattggccagtgcgtttgttctgtcacccctcagtgtcctaatgcccttcattgtacgtgatcttaaaaagacccttgccgaaatgttttctccgagtctggaccacggcctagattcaatatttggcatctgcaaatgtacatttacaaagtgattcatcaactagaaactgtcctcttttgaggtacaggaagataaggcaaaggtttactcaaatcacccagccagtgggtggcaggatcaaactgcctcgctcctcacagcttcagaggcctcgacagttcccagcctcactgcagacccacgcccacttctcatcaagctcccgaaatgtcggagctgccttcactgcgcacggcaggggagcccagcacagcaggaaagccccgatttctttgatcaattccgtcagtgctctgaagccacattatgcagcattttgttagcatactaaacaccttcagggtgtcaagccttgtctttgcagtgcgttccttagagaagtggaagtttcctgcccttgaggtttcctcttactcctcctgctcacttacggagggtggcggggggaacaaaaatagaaaaccaaattccatattctctttccttcccccaccccccccaaaaaacacagacaccccactacctcttcatttgtctccccagacaactctgtacttggaacctgcattacttgtgcttgctcctgggaaattcgctgcaatgtgcacagaggggctgtagcctgtcttcattcctcttcatcatcttaccaggctatttgtcatgtgagcaagctggaaagtgagtttggattcattacccatcccaggcattcccacaggcaccctccatgtgcgctgaatgcttctgactttgcaaatgatattgcccttgaagatgcaggaggcgtggagcaggtttccaacctcagccattacacagcacaggcacattacatggcacaggcttgccggccagtccaggcgccataaatcagttctcaacggtggcaccattcagaaaagcatgcagggaaggcagggagaccaccaagggctccaacccctcgtcagttctgcactgacaggctgcacaaattactctctaatttttgagagcctccacctccagggaaccctgccctcattcgatcattttgacagtgcatttgcaaattttctttattcggtacattcatttgctgttccttactgctcttgggcaccaaggtgctaggaatcttcccatttaatggataagaaaaaataggcagaagcgttgaaatgacttctcaggccaaaacccagtgttgcacatcccacaggagttggcccccagaagaaccgccacaaggatctgtcagggtgaactgagcttcggctaacgggtgttatgtcccagctcatctgaaggaccacagcttttcgagactcagattctcaccatgacccaattatctcaaaatagaatttctggttctcttagatgttgctttgtagagggcacaggcccttagaaagcacacacctgtcatgcaggcgtccttcaagccctgaagcatttaccttcattgatgactgctgctccatatggagaaagaattcctttaatgggtcatatgacctgtttgcttatttgccaacacagtgtttctaaacactctgtttctaaacaacagctagttgctaatgtcttggctgccctttaacaagagttcatggaaagtccttctgtggccctctcatgtcatgcctgtctgagatgcttctcccagtcatcttgaaaaatggtgctacataaccatcctgtcgtggaaatgatgcccggcacctccctctcacgggtttggtctatggttcagacccagacctaatccttgtttgttgagatcagtcactgagacactttgggtctcagcagctgtgctgagctcgcctcctcctctctctggtagagcctgaggcaatctgtgatccaagctgcaggccacgagcaaacaccgcaggcaacatccacttccagaaggctgtgttccacaaaagcgatgaggacacccatcctcaggggctataatgggaactcttttcctcctaaggccctagtgaggagtcaggaaccaaggtcatctttaagcttgtagcatcgggacacaccagttcattcaaagcagcaggcagcactagaagctcaagttcaaatcagtgacttgaaaggaaatgacacttcataagtagaggcagctttttcaaaatgcaagcaccttctcatccaagagagggtggggttctggcacctgtgggtcacacttgtggcagcaggcccagcattggcaggaacttcaggacgagcctctgaaggatgtggacattcccctccttgcctggagaagtgcttcctcctagagcccatggagatttgggattagcctctcctttctcagaactggaaacccagtactcaaggtctgggaagctggggaaaggggctcaagattgctgttagctagagcggggttccaaacccccaggccacagattggtacaggtccctggcttgttgggaaccagcctgcacagcaggaggtgagcagtgggggagcatgaccacctgagggctgttggctgtctgatcagtggtggcactggattctcataggaacctcatgctattgtgaactgtgtgtgcgagggatctagcctgtgcgctccttatgagaatctaatgcctgatgatctgaggtggagcagtctcatccccaaaccattccctactcccattgggtccatggagaaattgtcttccacgaaacctgtccctggtgccaaaaaggtaaaagggtttgggactgcggagccatggcattgaattcccatctcacacaggagaggaaaggctcttcctcaggacttggatgtatattacttagacgtaccatgaaattaagtagatatttgccaggaaaaatgcaaaggagtatcagttctccagatttgtttaagatagcatgaaacggagaggttcatgtaagaatctgtgtgtgtgtgtgtgtgtgtgtgtgtgtgtgtgtgtgtgtgtgagagagacatatgcatatttaacctcctttaaatgtacattaatgctgtattttctccccctgatttacagggagaatatcaatttagaactatttgcacaaactctagataccagtttagagcgttccctatttagaaataaaataaccaaagtctcaggttgccaggcaactgcagcaatgataattcttagtattgctgctttagaaatactcatttttatacattttagtgatggttaggatgcagagaatgtgagttcagaatgtcgctgggacatcgaagtcccttttctatgagatttttagcattctcacttgcttttatttttcccccttagctctgtttgcttccttggctagcggtatcttcatatttagctatagaaatctcgagagattgttattattttcttaagagttgaggcagaagctgccactacattaattctgccaggctcattatagaaccacgccagtcactcagggagaaatgacaccgtctggggatcggccggggtcacaaacactgggttcaagctttggttgttctgccgctagtttgacacatgaactctacacctcgtccttttcattcttaagaggaccacattctggcccctctcagagcttcactgaattgggaacagaatatcaggccccagctctgtcatcatctcttggcggcaaagccacggctcatgtttttgtctgtccactgcagcagccgttgtggcgtaatggcacatgatggtctcggggctgggtagaaattggaaggcgtcttcctttcccttttggcctttcaagtgtatcttcctttatgtctaatgtctggggttactattaaagtctttctgaattctgaaccaatgatcagatagatacaagagaatgattgggaatgaaaagcctgctaatcctagcagagtaggaaagggtagacagccccttccccaaccccacggcctcagtggaggagagaatggtgtggcctgcaggggagggacaggcagacagcgccagctgtcacccaggctcacgttcaccagcctcagcagtcagaccttcttccttcctcccttggaggaagtgaatagaagggcagaaccgagagcgggaactctatcttgatcttgctaaaggggtagaagttcctaattcgtggacttgctggaccacagggaggaggagaaaatgatttctagtacttatttcctggcatttcagctacatggaaggtagttagcacggtgcataaatgagcccccggtgagagtatttcccatcgtgagcaccacagccgggcgttgttctcactgtgcctcacaagctctgctaaatgccttatggatatttcattctgacaacctgtgacataggtactgtaatcatactagtatcacagatggggaaactgagacacagaaaggttgagtatcttgtccaagttcacacagctaataggcaacagggcctcactgcctcccagtttatcaccccccaccgagtacagtttctggaatattgtgctcggtcaacatttgttgcaataacaagtggggtacaacagaggatcaaacataccagcaaagcttgcatatgtgtagttgattataagtaaaagcacagtctgggcacagtggttcacacctataatctcagcactttggaaggcctaggcaggaggatcacttgagcccaggagtttgagaccagtctgaacaacataaggagacctcgtctccacaaaaaaaaattaaaacactagctgggcatggtggctcatacctgtagtccaagctacttgggaggctgaggtggaaggatcgcttgaacccaggaggttgaggctgcagtaagctatgatcgtatcactgcactccagcctggacaacagagcaagaccctgcctctaagtgagtgaatgaatgaaggcacagacccgaggggcagggctgatggtagccaattcatacattcaggtcggtctcctggtctcacctgtttctgtgattgctaagccaggctgatggctagatacccatggcaatgaagaatgtaaaatacgaaaggtaaaaaagggaaataaatcttcctttcaggacccaagctacttatcagggctaaacaaaaaataccaagtaagaatgtaatgatgaggggtggggagggggcaaaaaataaaattaaaaagaatgtaacaagcaacgagacgctcctgactttgaacctgtgtgcagggctccgggtagattagaaggcatcctaacctcagtaaatggctgtcagtggggcctgacagtctgggtcccgtgttctgggcaccaccaatggagggtatcctctcagaaagcttcaccctatttcatgagcctttaataaaatatagctataatctttctcgtgaaagagcctgacagttcatggagccacttcccacgccgcactgatgggagaaactgcaggactccaccaggctttctctggctccaggacccccacgaaggcctcctgatttatctggggcagctcctgcataagaagggtgaccgtttcccacagtggagaaccagacactgggcacagcccacttgataagacagcttccatctcccgcccctcctgggtatgcaaaggcattcctgagtgaataggttcaggtcagagcaggagaggttatcacccaggctgtgccttgaagctttgctgagtacaagaaaggtaaggaagagataagcaagaggtgagaatgacggcagggctggcaagtgagatcacgagcttttcctcaaacatctggctaagaatagaagctttgggaaattccacaactggcagattaaggtgatcagcctctcagctggaatttgtgaagtttcttcagactgagctcccagagaagtatgtgtggtggaatcgctgtgctttctaaagagatggattgcaacctgcgccgttgagctagtgctgagctgaggcccggtgagatggattctagcacccctgccacggctaacctcacacactcagacgctctccctgagcttttcatttctccatcagcaaaatctcaatcattcttactcctcgtccacctcagaaacatattgtaggttccatggagacgatgtctgtggtagacaaagagacgtgcttcaaaggcagaaaggtcactgttttatcatctttcagaatcgtgtaacccacgtggttctgccaccatcctgtcttctgtgcattccttgactttgaaagtacgcatcttttcttttgaccaagtagataattaccgtctatcgaaatgaaccctcatgcatttattcaatgagagtttgtgtgcctaacacacagcatggctgcctgatacagatacttggtttaagagaattctacaggctctgcacgaaagtgaagtcatgatgtaaggaggcaaaggactctgccctcaaacagtccaatgggcctgagaatgagcctggggtgggggttcgatgctgctgcacccccagttgtatctgtgtatcccagtgactggggcgtgatttgaatatttaaagatactcctttttcatacggcctttaaatgcaagccgagtacttctgctgcacagccggagaggtggtatgtttttaatgctggagtaaaacttgtctgtgttggacttagtgagagaatggttttcgttcagagattgtcaaggccaactttgatataaatttcactttacattttacaccacacgtgattcataacatttaactctgtcatccatagaactcggtgctgttctgatcagcaaggtagattctggcccaaaagaactggtggaggaatttaaggaactggttctaagcctaattgaggtcaccaaacatacagagaaaataatctgagaaatgtatagcagaaatctaagttttccatttattcatttactcaaaaataccctacaataaataccaggaatataacagatgatctgcattcttgggcaacttacagtgtagcaggaatacagacactgagcaccgagtaactgataatatacgcacatcagcgctgaatcggcactaagggaagaaggggtcgggtggggctgaggaatggcacagagcggtgattctcaagctctctcctcctcgagtcccactcattctctactcacgctcatctgtgtcttccaaagtttgccacagtccgtcctctaaatgcctgagtcattcacacctgttctgtcattccctgctttgatatagagatgatccaacacaaatcatgacaaaccactaagccaaatgcaagactctgaatccacagctgagtgtgatctttaatgacgactaaccatcatatcacaagttgtgtcataaccagaaacaaaacagccagagaaggagggctttaggttggtctggggacagtacggagagcccaagacgcccttgggcacccacagggggctgtgattattcaaggatggcttgatttaggcacaattaggcattggacaggatggagcatacaaatgtgttggggattaattcattaaaaatctgtcttgagctttaatagagcttcagtcagagtgtccaaccataaattctcacctgtttcacaactggttcaggcccaattgagcattaacagatttttttttttgttcatgcaaatgaggttttgtgtgtaattcattcattcatttcatttatttcatgtctaattgaacaatttttgaatagttacatttgtggagtagttaagttgtatcaaattgtctaatgtacctagtaattttgtaactaaaacagagctgaatttcattttgatataacaaaaggagaaccacagaagtagaggtggtttgaggaatagtcggcttttaagagactttatgatactctgttctttagggcaatgaccacagttgctgtttctttttatcctcacttttctttcttttcactccctaccgatgagatcaatgaaaatttggggggcatttctagatttggcagcctcccatttataagcatacatttttttagttttgtgccctgacatgcccatttttctgagggtcaaatgtgtctgtctttaaaacaccgcgttggtgtctttcaaaccacttatcaagggttgtttctcccacgagaccttgtcacccctgagcctgaaatcgcgcgctgagaactaattgcagtagctgcatacacacagtgaacaaagttcactgctcccttcattaagggcacctgccatatccactgtttccttccgagaactcttttggtgaagacgggatttttgttttctttacattccacatagctgccagaaggcccctttaaaatgcaaatctgatgtctctcagtctttaaaaccttcagtggcttcctgttggctacaggatagttgaaacccttttgtggcctatggagctcttccgaatttgggccacacctacctttctgaccatagaaactacatagagatgactgaacaccccaccccacccccacagtcacatgctttgccgatgccgattcttctgcttccagcggctgttcattcactcactcattcattcattcaatcaatagttaccaagaacataccctactccagtactgtactggagctcctcctccatttgtgagattcttcttatgtctttgacatgttttgattgtaagatgtgttgcatatgcagatgtagaaacacacctactcagtctatagaatgacaaaaaatctgtgtgcccaccacccaggttaggaaatagaacattccactagctcaggtgcccttgtgtgatcgtctgccttccgtcaccctcctgcctgttccagcggtgaccacagtgctgaattttctggttttgatccccttgcttgtcttataggttttaccacctaagtatgtgtccccccaaaacatactgtttagttttgtctgctgttgaacgttacgtaaatgaaatcatactctattctatgcccttccgtaccttcttttgatcagtatttcatttttgagatccatcttgatgcgcacagctacaggttcttaatcttcattgctgtacgatttttccattgtagatggatattgcaaaatattcttctgtgggtggatttctaacaagtttttaaaaactgattgttgaagttaatcgaacctatttctgctctaatgagatgctcacttggttcctccattaatcatttaatatggtcaattacattgtgagttttcttttctttttgagacagggtgtcactccgtcacccagactggaacgcagtgacaccaacaaggctcgctgcactcccaggctcaagtgatcctcccacctcagcctcccatgtagctgggactacaggtgtgcaccaccatgcctggctaatagtttatattttttgtagagacggggttttaccatgttgcccaggctggctttgaaatcctgagctcaagcaatcctcctgccttggcctcccaaagtgctgggattacaggtgggagccactgtacccagccaatcagttttccattaataatactaaaaattcttggattccttcctacttattctttgaggcttatctcaaatatcatctcccctctcaagccttctctgatctcctttcccccctcctaattctttgctccaggaaagttgtttccatcttccaactcaatggcattaaaatggtattttaatgtaggcacttatattttaaatatttgtttacatatacctctcctatcatatgagctcatctagataatgatagagggcacatgcagtggctcacacttgtaatcccagcacttcaggaagccaaggcaggaggatcacttgggcccaagttcaagaccagcctgggcaacatagtgagactccatctgtacaaaaaaaaaatttaaaagtatagtagccatgcatagtggcgtgtgcctgtagtcccagctactcggcaggctgaggtgggaggattgcgtgagcctgggaggttgaggctgcagtcagctatgatcatgccactacaccccagcctgggcaacagagcaagaccctgtctcaaaaaaataataatgatggaatcttgttcttcagcttccttacgattttgcactaatctgaatgaaaccagcctgatctaaaccttgcatctttagtgacagatatgagtctgacacccaccttcaactttgtggtagcctgcccagcttcccagaggacacctttgtgcccgcaggcttcctgtggccatcggatccccaatctaaactaggataaagtatatgttttgtggtattgtcacctgtttaggatgagaagaggcactgaagctataaccctattttctgagccagataaaatagcaaacatatatttgctctaccgggttattttgacaaatttatcaagcatcttcaaaatatacagtactagtctaagcattagggctaatgcagagagcttttgcaccagtaggacagaggaaaaaatgtgcacaaattagagtacaaggcataaagcagttaaaagtcacattatcaagtacattcaaggaaagaggtaagcagttccagcaagtaggccgggcgcggtggctcacacctgtaatcccagcactttgagagcccaaggagggcggatcatttgaggtgaggagtttaagaccagactgaccaacatggcaaaacccaatatctactaaaaatacaagaaaaaaaaaaaaaagccaggcgtggtggaacatgcctgtaatctcagctactcaggagcctgaggcaggcgaatcgcttgaaccccgggaggtggaggttgcagtgagccgagatcacgccattgcactccagcctgggcaacagggcgagactccatctcagaaaaaaaaagttccagcaagtcagctgtgaatattttttctatggcaataataataaacacaagatgcaggtatagattcctatttatgactacaactctccacatgtctagaatttggtggaagcaaataggtcttagaatttaccccaaagcttgaattactgaaactgcctgttagtaatagtcatttatcacatggatttggcgctggtgtcgtgaggatctaagtacagggaagttctgggcatgttcatttgccatttattaatttctgttctttgctattttttgggggggcgggtaggggagacaaaggtcttgtcacccaggctagaatgcagtgatgtggtcatagctcactgcagccttgatctcccgggctcaacagcgatcctcccacctcagcatcctgagtagctgggactacaggtgtgcaccaccatgcctggttaatttttaaaaatttttttctagagccagggtctcactgtgttgcccaggctggtcttgaattcctgagctcaagtgatcctcccatcttggcctcccaaagtgctgggattacaggcatgagccaccgcacccagccctactttgccattctttatttctcatcttaaggtggctacttagcttggcagtttccccttcttgttctgtaagcacctacgttgctctctaagtactgctttgtctgtatcctcaagttctggtaatgacaggtattttcactatcattcactcaaaatattttccatttctcattgtaattatcattttttgagacggggtctcattctgtcactgaagctggagtgtagtggtgcgatcttggctcactgcagccttgacctgctgggctcaagcaatccacctgcctcaacctcctgtagctgggactacaggcgtgtgccaccatccctggcttttcttttttcttttttttttttttggagacagagtctcactctgttgtccgggctggagtgcagtggcatgatcttggctcactgcaacctctgtcttctgggttcaagtgattctcctgcctcagccccccgagtagccgggattatttgcgcctgccaccatgcccagctaatttttgtatttttagtagagatggggttttgcatgttgccaggctggtctcaaactcctggcctccagtgatccactccctgcctcagcctcccaaagtgctggaattacaggtgtgagccactgcgcctggcccattttaattattttgtgatccgtgggttatttagaaatgtatttactaatcgccacagttacttggaatttgttccttttgagccttttaagccttgcaaaggcaggtgcagcacagcctagggctgctttgatcccactgttagcgcagtaaccttctgaggacgctgaggaatgatttacatacactcacatatatatgtacacccattatatacaccatatatattatatacaatatacacacatacccaatatgtatatacacccaatgttatatatatatatacacacccccaatatatatatacacccaatgatatatatatacacacacacccaatatatatatacacccaatgttatatatagacacacacactcaatatatatatatacacccaatgttatacatatatacacacacaccaccaatatatatacacccagtgttatatatacacacaccctatatgtatacacccaatgatatatatacacatacacacacacaatatatatacacccaatgatatatatattacacacaccatatatatatatacaccctatgatatacatacacacatacccccatatatatacacccaatgatatacatacacacactcaatatatatatacacccaatgatgtatacatacacacaccccatatatatatatactcaatgacataaataatatgcacacccaatatatatacacccaatgatatatatattacacacaccctatgatatacatacacacatacccccatatatatacacccaatgatatacatacacacactcaatatatatatatacccaatgatatatacatacacacaccccatatatatatacccaatgacataatacacacacccaatatatatatacccaatgatatatataatatacacacactatatagatacacccaatgatatatctatacacacacacacccaatatatatacacccaatgatatatatactcacacacaccctatatatatttacacacctaatgatatatacacacacaccctatatatatatacacccagtgatatatacacacacaccatatatatatacacacacatacacccagtgatatatacatacacatacccgatatatatatatatatatatacaccccatgatacatatatacacacacccaatatatatatatgtacacccaatgatatatatacacacacccccaatatatatacacacccaatgatatatatatacacacaccctatatatatatacacccaatgatatatacacagacacccaatatatatacacacccagtgatatatacacacacacacatccaatacatacatatacccaatgatacatatatatacaatatatatataaacccaatgatacatatacacacacacccaatatgcatatatacccaatgatatatatacacacacacacacacatgcatgccctgggtataaacagatctcctcactctgtctgcttgaacacagacttccaatcccttcttggcttcaaggattattccaactctcctttctgtggccttgcttgtttttttgtacacatgtggattagagctcaaccagagggctccagagagctcttgcttgctctcaggtcacctctgtctttttttttttttctctcttattctctttcccctcttctatctctccaattcttgctttgtatctctctccattcttcccttctgctattttgtcctacaaattttagctgccctgatctccccaaagtctggacttttccttgttcagaaggatgtggctgcctggctctgcttgggtcccctgtcgtgtttgggggcctggaacctctctcctggcagtaagctggggcacttacaaggctcagctcatcttttccccttctctcagacatgactttcctctgctgcttgttacccagtatcagaaacccattttttttttcttatagtttgtttggttttctagttgcttaaggttggagggtaaatccagtttctatttttcaaacatggccagaagcagaaattttgtcatttgtgatcatttttttttgtttatttctttaaacagtttaattgtctctaacatgttaatcaactttttgttgtttatttgtgatctaggtttgaacatctcattcttgcatctgtggtttctgctggctctttctcatggtgccgtgtttctttgtttatttgtgtctgggggctactcattttcactggcattttatttgtgagaattctgcaagctctgggataaagatagtttactccagacagcatttgtgtttacttctaccaggtgccagttgaggatagtctaaactacattctcagcttgaaatatttttgaccacccagatatggagaactaagcgtgcaaacctgcatgtaattcagaccagggttcgcaattctcaggacagtttctttcccctctgctcagtgcttatttcaagacagtcatgtcttgaatacctacaagggacaattattgggggttgattttcctgtgaaaattcacatgtggagcaggcctccagctttgactgctgccacataaaactcagcagggtgttacctggctgggcagatgtctttggggtgaaagaaagcttgcctgttctgcttatttatcttgagttcccaacttcacttgcttttttttggcctgaggattctttacctttttgcaggttcaacaatgcatttactaagacttaaaaataatatccacggccgggcatggtggctcacgcctgtaatcccagcattttaggaggccgaggcaggcagatcacctgaggtcgggagttcaagaccagcctgaccaacatggagaaaccctgtctcgagtaaaaatacaacattagccgggcatggtggcgggcgcctgtaatcccagcaactgaggcaggagaatcgcttgaacccgggaggtggaggttgcagtgagccgagatcacgccattgcactccagccttggcaacaagagtgaaactccatctcaaaaaaaaaaaaaatccacaacatttaactgtacttggtaagaaggttttcctaggaacccagcctatcatattgctcctttgcttttttttttctcctgttacacacctctccttcttttaaataagtaaggagatcatataacttattatcgaagccacttttgagagtgaaaagggacacttaattattattatttcatgttttgaaatattttctgacacagccgtctatattggtgaacctataaaacagttctattcaaaaattactttcaaacatgaaatgctttcttaataaaagaaaatacatcaaagtagaaaaaggttaaaactgctttatattgtttatctggacattaaaaaataagcagaataatcacttaatatacttttgtgtattttaatcattgtcttcactatcttctaataccacttcagtagtatttttcttaacactattttttctattgttaatgtcagggcgtttttctccttcacataatccaactgccttacctatatatttacatatatgtttatgtgcattaacacatcaaaccatctgtttttgataactgtggcttctgtttctcttgatagaatatcacagtttgtttaaaaataagtgtgaatttattcatacaaccaccaattacaagtttatttcagtgaaatacatttctcaattcagtgagaatattgtgtgttaaagtttcaaaggatcttcccacaagtcaatttccagagcatacttgtagaatttcacattttaatcttctatacagtttgagctcttgtcatctatatttcagggtcccctgtttgcaaattttgtttttaatcattgcaattcattacaggcttcagaggctgagctttttgtgtttcattggttgaacacttgattatggattacaacttattttgaaccacaagccatcaaaatttagatgacttgtttccaaaactggagtactttttttgtagagcatttggattgactcatgaagtatgttttaaagttaaaagctgcctaatgtcagcaatttcctatcatttcattatttcaagtgtcaaatatttctcaaatccaacttgacaggcagcaaagagagaaccgcacactctactgatgaaatgtttttaatccaatttaaacttcataaaaaatttttgtagttcagttactctcagtttatgtaaattttacacatttcaaaaactatagcttgtgcttctctgggtagaattagaactgtgtttgagctcagttatgaattacataggtacatcaattacaggtacatttcagcataataagtttctcagcttggaacattatatcttttttttattttttattttttttgagactgagtctttctccatcacccaggactgcaacctccgcttcccgagttcaagtgatcctcctgcctcagcctcccaagtagctgggactacaggcacgcaccaccatgcccagctaatttttgtatttttggtagagctggggtttcaccatgttgcccaggctggtctcaaactcctgacctccagtgatccacccgcggtcagcctcccaaagtcctggcattacaggcatgagccactgctcctggctggaacattatgtccttttttttttttttttttttgagacggagtctctctctgtcgcccaggctggagtgcagtggtgcaatctcagctcactgcacctctgcctcctgggtttaagcaattctcctccctcagcctcccaagtggctgggattacaggcaggtgccaccacacttggctaattttttttgtttttagtatagatggggtttcaccatattggccaggctggtcttgaactcctgacattatgtcttaaagtgctaactctgttcactgcacataacctcatatgttcctagatgagaccactgaaatagaaagtgaaagtctatccaattcttccatctcattttaataagtcttagtaataactacttgtattttgaataaagaaatgaaaaatccaggacaaaataaaccagacaggatgcagggtgataggcatacactgagacttctaggcaagtgagcaactggtcagccgaattaaagcccttggaggggttcctgtaccctaggttcttaatacatgcttgttgaatgaacaatcggaggtagcttatttgtttgaataaggctttctgtgtgttactgcaaaggaatgaggatgggacaggtttaggctttgtaacaagacctcccaaaggctaacacataggcggctgcttcctcggcaagcagagatgacgcttgtggccctttttgaaacaccttttttacatgccagaggtatttaacttgtccgtaccaaatggtacggacaagttaaaagggttatccgcccttttaactcaaatatcccgttgggatcaaacatttttgctctggagacctttgtacctgtgcagcatcagtataaggatagcctgggggtggtaacccagacacagctaacagcggggtctgagtggcttggccagagtcttggcctcaaattgagggcacagcagtggttctgactgttcctcttcggggaacgttgtacatcaggaggggcctgatggtaatgttggtgtaaaatgtctctgctgtgatccacccttgaagactgtgagctgtgcagaacgaagcaggtcatggcttgtcctctaggatgtgatgggaggctgaaagcatctctctgctgtgacgtaggagggaccgtgagccttatgctaggcactccttccagcccaaggcagcatcgtctactttggttttctttctttctttttttgaaacactctgcccaggctggagtgcagtggcacgatctcggctcactgcagccttaagctcctgggctcaagctatcctcctgactcagcctcccaagtagctgggacaacaggcgtgtgccaccatgcccggctacttttttaaatatttttaatagagatggggtttcgccatgtgtcccaggctggtctcaaactcctggattcagacaatctgcctgcctcggcctcccaaagtgctgggattacaggcgtgagccaccgtgcctggcctgctttggttttattctgactgtggctcctaggaagaaaaagaaaagatgatgctttggaagctgtagggttgggaagctggagacttcttgtgatggagaggtacacccagtagatacttatttaaatacttatagaaagacgactttatgccggacactgtgttaggtcctggctatacaggaagaagagaagtggcatctgcccatcctacgcagttctccaggaaggaggtggcaggagtgacatttgggccatccaggcaactcaccaagtcccttcgcagcactcctgaaaagctctgagatgttttgaagctaaaacagacaaacaaaagggaccaaagaggtggcatgagtagcatgagtcagatgtgattaattcctaattccttagctgcttctgtttgtttgttttgttttgtgtttttgagatggagtctcactctgtcacccaggctggagtgcagtgcagtggcgcaatctcagctcactgcaacttccacctcccaggttcaagcgattctcctgcctcagcctcccaggtaactgggattacaggcacacgccaccacgcttggctaatttttgtatttttagtagagacggggtttcaccatgttggtcaggctggtcttaaactcctgacctcaagtgatcagcctgcctcggcctcccaaagtgctgggtttacagatgtgagccaccaagcccggccccctatttccttatcttcttatccgcagcaggactttgagaaacggctcagttagggtcttgcagggataacagtgattagagcctgaacacaaactacatttatcccatgtcagaaatgaatagcttatcaaacgtaccaacttaaaagatgcaagaattgtgcaacaatagctaccttcttttcaaacaaaataaacatcactaaaaaactctaatcttaattctttttcaagaaatggataattcctccacatcattctcctttaaaattttgtagattctcccttaagttacttaatgtatgagttgtggcttctgtgtaacgtcttttctcaggcttgtattggtaatggaaagcattcttcagcttaatttccttttaattccttccaattactatgcactgttctttgtgccaagtgccagtccagttatccagttggtgcattttgtgagaactgtaggatcatggagatcatgtttcttttcttttcttttcttttctttttttgagacagcgtcttgctctgtcaccaggctggagtgcagtggcacaatcttggcttaccgcaacctctgcttcctgggttcaagtgattcttctgcctcagcctcccaagtagctgggattacaggcacgcaccaccatgcctggctaattttttgtagttttagtagagatggggtttcgccatgttggccaggctggtcgcgaactcccgacctcaggtgatccgcctgcctcagatcacccaaagtgctgggattacaggcatgagccactgtgcctggccaggatcatgtttctttaaaccacacatgatacccagaaggcatcataatagagttggcttcatcatcttccttatcctaggttatgcttgatttcaaaagaaatttgttcctcgacaatacacagaaaatgcacttaacaatagcccctgaagttttccccagccaatgactggttagcagtctaataaggatcatattggacaagtatctttaacacaaaacagcacagggaatcatgggccactctcatcgttaggctctcttcacaggtatagcctatgttagaaggcttctgaaccacagatgctaaagaaaaattagttaaactgaagactgatgaagtattccctacaaatgaaaaggcaatcttatatgacaaaggacactatcaggaggttgaaaaacaacctatagaatgggagaaaatatttgtaaatcatatgtctatgattaatatccagaatatataaagaactcctgtaagtcaacaaccatcaccacacccagttcacaaatgggcagaggaatcttatggacatttctccagcggagatatatgcacagccaaggagcacgtgaaaagatactcagcatcattagttgctagagaaatgcaaagcaaaccccaagaaggtaccacttcctagccagcaggatgtagctattaaaacaacaacagaaaatcagtgttggcaagggtgtggaggaattgcagtccgtgtgcgttgctggtgggaatgtaaaatggcatagtcattgtggaaaggagtgtggcagttcctccaagagtcgcatatagaattgtcacatggtccagcaattccattcctaggttacccaaaagaatggaaagcaggggagctggaggccattatgctaagtgaagtaactcaggaagggaaagccacattcctatgttctcaggtataagtgggagctaagctgagggtccacaaaggcagagtggaggaatggacattggagactccgaaggggaaaggagatggaggattaaaacgctacattttgggtacaacatatactacttcggtgacaggtgcaccacaatctcagacctcaccactatacagttcatccacgtaaccaaaaaccacttggacccctaaagctattaaataaaataaataaatataaacattcagtaacattatctttagaagaacactttttaataaacctgggcatgaagaaaaaaggctgaataatattccatcgtatgcgtgtgtatatccatatatatatatatatatatatatatatatatatatgcacacacacacacaatgtatatgtctagtgttaccaacttagtttcctttccttcaatattaaacgtctcatatttcccccagactttttgagagatagttgagaaataaagctgtgtaagtttagagtgtagtatgtgatgatttgatatatattgtgaaattattaacacaagttaggtgacacacctgtcacctgtcctagttatcatttttttttgtattgtagtgaaataaatgtctcatttaaaaaaaaaagaattgaaagcaggaaatgaaacagatacttgtataccaatgctcatagtagcattaagcataatagccaagaggtaggaacaacccaattgttcatccacaaatgaggagagaaaatgtggtatgtaaatataatggaatatacgtttcatggaaaagaatgtatctttcaatttttaatttttgtgggtacatagtaggtgaatatatctatgggatccatgagatgttgggatacagacatgcaatgtgaaataagcacgtcatggagaatggggtatccatcccctcaagcatttatcctttgagttacaaacaattcaattacactcttttaggtacttaaaaacgtacaattaagttgttatagtcaccctgttgtactttcaaatactagatcttattctttcaaaaattggttgaacctattaaccatccccacatcccccatactctcccaatacctttcccagcctctggtaaccatccttctactctctatgcccatgagttcaattgctttgatttttaggtctcacaaacaagtgagaacatgtgatgtttgtctttctgttcctggcttatttcacaaaatgatctccatttccatccatgatgttgcaaacaacaggatctcattcttttccatggctgaatagtactccattgtgtatatataccacattttctttatccattcacctgttgatggacatttaggttgcttccaaatctaatggaatatattattcactcataaaaagtgtgaaattctgatacatgctgttaatataacacggatgtaccttgcaagcatgttgagtaacataagccacaccccaaaggacaaatattgtatgattccacttatacaaggtacctggcacaggcaaattcatagagacacaaagtagaatggtggttaccgggggccgggggagtagggagtggggagttgttacttaatgggtagagtttgtttgtttgggaaggttctggagataaaggatgtgatggttgcacaacaatgtgaacgggcgcaatgccactaaactgtgcgcttagttgcaaggttacaataggacattttatgtatatttcaccacaataaaaataggaaaaggcaggtgatttctaaggacacaagtcccttggggttgctagttctgtcagacttttccccttgtttttctgaatgacaaggattagtagtggatgataatgagtggattcatggatttgagcaggacatgaaacaatttccatagacagagatgaaagggcatttctgacttgaaacctgggatgagcaccgatgcaggagaggcacgaaagctcacagcgtgttcagggcgtagtgaatagaggggtgcgtgccccgagcctgcagagcgggcagggatgtgtaggaaggcaccttcatcctcctcactcagcctcccagctccaggtccaaagccgccaaatcatctttcttgtcaccatcacatgataagggggagtccttccagactgccagtcaatgaagtaacacacacagccacggtcatgccagtctgagcccatcgggcgagccctgaggggaataacagtcttggtggcattgggcaagccccgaggactccatctcggggaataacagtcttggtggcatcggcgcttcaccaggcctcctggaaccatattcgggatccccaactgagtgctggaaagaccactggtcaggagcagggagcaggggtggaaggaggtggctcgtcctgaccttgacaatgagaatcctgttttaagcttcacgctgctgactaaacagaaaggccacggcacagggacagacgtgcgcatgaaatcacaggaagaaagacatttcacgaacaaatgcatcctcccaaaccagtctgaatccctccggacagggtgatgttaccacgcaactggcctggcctaatgagctggtttctgtcatccctcctggaaggttaccctgtaacacaaggcgtgcccactgacatgcagcctgatggagcaaggttacacctgtctgccttttgtgtgcacaagatcagaacacagtcaagtgaatacaaatgcaacagctgcttggggctcaaacttgcatagtctattttatttggatagagagcataaaattggctctaccaaagtctggaggctggaagtaatcataattgtaatctagtataattaccaagcctagacctttacctagtcctatttaacctccctttcacctttccaaggaatgtggagggataagagagtcactgaataagttggttggtaatactgtattgtatctctcaaatccattgtttttttttaaagaatgagatcaataaatataaattccaatattttcttccccaaagcaccatcttgtaccgctttggagaacattagagggactcacctgggtttccagagctggaaaacataagccccataatgcacccagtccccacggcgcgctgccatcttaggcccagtccccactgcacgctgtcatcttaggcccagtccccgctgggcgctgccatcttaggcccagtccccgctgcgcgctgccatcttaggcccagtccccgctgcgcgctgccatattaggcccagtccccgctgcgcgctgccatcttaggcccagtccccgctgcgcgctgccatcttgggcccagtccccgaggcccagtccccgctgggcgctgccatcttaggcccagtccccgctgggcgctgccatcttaggcccagtccccgctgcgcgctgccatcttaggcccagtccccgctgcgcgctgccatcttaggcccagtccccgctgcgcgctgccatcttaggcccagtccccgctgcgcgctgccatcttaggcccagtccccgctgcgcgctgccatcttagggttttgcttagggggcagatagaaaatagtaaatgaaaccctttcagatatttcctggccttatttagtaaacacgtctttttgaaagaactctgaatacacctgcagatttttcaaagcccagattctacacacttctaatgtcaaccttgaagggagatcgtagattgaattacagaaaggggtgctgtcaaaatgccacatcaaatataaacttcacatatgtttcttacctgaaacactcactcacactcatggaaaagcacaggaatgttctaaaaatgcaagtttatcacgaaggagacacaggaggttcagagacgatgaagcggcaagccgggaggaaagatctgagagaagccaccaggctggggcaggatttcattatatccagaattccacttgggctctgcagtttctttcttcctgagaattatttaaaagtccctggggaaggacaagagtaagaaaaaatcaagggagagcctctgggttactatgacaacatgactcttgaccccttctctctcacccagcagtgcctaagtcccttttgcattgctgcagagatctctggcactgtgattagcacatactcctaaacctgaggatgatttaaagtggaaggagatcaaagtttctaaatagtacaatgagctcatcttgactcaaaagatgtgtaatggttataatgcaacataactgagatgtttccttatcccccccaccagtaaagctggtcacagaccgttgcaaaggctctgtgaaaaatgacaggtctatggaaatgtctactgcaaagcactgataactcaggataatgattcaggccaaaaaaaaatttaaaaggaagtgaaacttcagacaatgtgaaacatgtcagagtcgtgtttgcattctaaattgcagtaatgatataaacatcattattcctaatctgatcctgcaggtggatcaaatacgcacacatctattaaagaacagtctgcatgctcagtaagtgcacagggtcttattaccgaatctttcagcacatcttcatttcatctttaacttcattagaatatgtaagttttggcagtctattgattcaggagaaatctatggatctattattttctatttgtctataaagtccactaattcaccttctaagttgttgttttgggttttcatcaaagtgatgacattccaactcctgattatgctacattgaataaaaataaatgtaggattttctcctttctgacctagagctaataagttgtacatattggctgagttactgcaaagaaagggcaaaatgaaaacacagctcttatagtcaaggttcttaggatcttattgagatgagctcctcagaatcagccaaacttcaaacatggagagcacggcccccagtctgccaagtcggcccaagactactgacacctactgcaagcaattagggtccaactacaaagttagcagaaagagcccacccaagaccactgtcacgtgtgacaactgcatgtttggagggttcccaaaacgaccctcaggctcgtaattctctagagggactcacagaattcacggaaaatactcatggctacaatttattatgttggaaaggagacagattaaaatcagccaaaggaagagacacatggggcagaatctaggacggtttcaaaagggacgcttccattgtcgtcaggacacattacattaccttcccggcatccgtgtgtgatggtacacgtggagcactgccaacccaggatgctcacctgagccttgtatccagagttgttactgtggtttcattacattggcatgattgattgattgatttcccatgtggtctaactcagtctccaggtggactggtactgtgtgaccccaaagcccctgccctaaatcacatggttgatccttctcttgcaaccagcttggaccatatgactatcaggtatggcccatcctaccctaagatcttatgtggccaaccctcaccataacaaaggcactcccagtgagtatgatgtagtttacctcccagaagctcatggaaaaggccacatctatctttgggaaaggtcaaattttttactacccaagcctgacctgagaagtgctaaattgtgagggtggaaaggggctagtgtgagcttggatgaacgaagtatctgaagagcaatggaaggaacatggaatgttcttaaacaacagaacatttttaggaccatagagtattggagttgaaagaatttgggagattattgcatttcttaataagagcactgccatgcagaagtggccttgtcttggtaacatgatagaagcacatgataactgtctttaaagtgtgaggggcccatgtgagcaacagggattatttttaccccatataatcctagagaacaaagccagtggccatgggttagaagttattaaaaagaagatttaagtttaatagaagaaagagctttctaataattgaggctattcagaatattacacaggctgtactgggatatggtaagttctcccaagttaaaaatattcaagcagaaagcagatcacctgttaccatggcagtgcttttattaggaaatgcaataatctcccaaattctttcaagtctaatactctgtggccctaaaaagagttttcaatcttgacagaattgtattctggaattagtggactatttctttcataagtcattatgtgaattaccttgaaaatttctaatatcgtacctgagtgccatggccttggcatgaatatacacttcctgagcagaacttaagaatgagaatatctggagtaattcaggttctgctaattctgcatggttgtcactgcgatgatgttcattgttctaggtaagaaggataaatgagtaataaaagtttcatgggacacatataagtgaactcatgttttatatccacttcagtcattcattgcaagcgagtcttgttcaatgagatcaaagcagattggttaggattttgacttgaaaccttctgttatttataaattggagttacatcatatatttcttctaaaagattctattgagactgtttgctgtctacagctggtctttctccagaagtaggttgaattgccatgaattttatcttattcagataaatagaatgctggtatctaggatccaatagattcatgtggcccaaatttcatccagacttcatcctcctctgtgtacagtggcaactattaaaatcataacagagacttgttggctccagcccatacttgcaatgtaaaacctccacttggtgcaaactctttccatccagtattttctgatgtccctgagggctctcatgaatgctcatcacacgtctcctcctggaaacaactgctgcttcaccaagaatcgcaggccccacggggaaccatcacttctctcctgcctgtcactgggcacagccaccaacattccagagccatcatggtgccagccccaaatgaccaggatggtgtcgggaagaacgcgtctctcccacgcattatcctgcctcagaggcatctcaaatgatgctgcttgcacctcagggttctacagtgtttcataaaaagagatcgatgagcaaataaatagattaacttcatgtactcttaatagttcaagacctctgccaaccagcggtctcaggataagcaagacatgacctcataataggaggtgtgctggttggatcacaaaggctggtccttcagccagagtgggtggttctctgcagggacctcttctaagctctccttgatgagacaactaatcatcgtgtacactgccgaatgacagtgtttgcagaacctctagcatgcatgctggcctcggctatctctgccaatactttattacacaagccagagtcaccttcatcggaagacttgagaacttggcttctctatcccacgaatgttatgcagtcatcttcccagcatcctgcaggacagacctgcttatgccatttgcagtacaaacaaagtactatctatctgaaattgagcagcaagtactttaacttcacgtacctctccttctgaaaatgccatcaggatagctcagcccataccaagcttctggtacttctctagtaccccaaagcaagtaattcatgccctaaggcattagcatccttgaagggaatgttgccaagacaaggccacttctgcagagcagataccttccccagaggggaggcgtccaaagtcttgcctcaaacgtaggaatgttcaggaagcagtcatggacagcgagatcatcaagtcccttaggaataagtaaactcaaataaaataaaaataaagtgattttcccttttggaggtatgtgtttcagtctggcgcaactcaacactgtcagaaataataaagacacttacttgagacctaggagaccctttggggcagaattgccctcagcagagctggtgatggtttcccttgagaacagcctttcccatgagggataaggaactgcggagatgctgctcaccttggccaggagcattgggccagggatgatggcttgggaccctggtccctggcatctcaggctggtctccaagggtcactggtgacctttcaggggacaaaagaaaaggatcttcacagatagttggctgtaaataggaaggaggcagggtcagtggtgaggaggatatttgaacagtcagcgtgtatttcaaagccgtggttctgtccccctctggtgttgcttccttctcctcttcactctgcagccgcctcttggtggtcagagggtgaatgcagggccctggggtttggggcctagggctgggagatcagagctcttggagctggcttgatacctggcaatcctcatccagcatctccatctctctacgacgcgttctggcacgttgcaggtgaagtgggtagagcgtgggatggttactggaatcgatgtagttccagggtgctgtccttaagagtgcgagtggtaccagtcagtgttctcggcatttaaatattagttgttgttatcttggctatctcatgcgtgtaagaattctgtgtgtgtagtttccatccttaaattcaaccaaggtattactgtaaaaaaaagcaagacaggcctggcacagtggctcacgcctgtaatcccagcactttgggaggccaaggagggaggatcacgaggtcaggagattgagaccatcgtggccaacatggtgaaatcccgtctctactaaaaaatacaaaaaattgctgggcgtggtggtgcatgcctgtagttccagctactcaggaggctgaggcaggggaatcgcttgaacccaggaggcggaggttgccgtgagctgagatcacactactgcactccagcccgggtgacagggcaagacttcgtctcaaaaaagaaaaaaaaaaaagcaagacaaaaactctctcccttttctagaaaagagcatgcctgtgcgtatggctggctgtgtgcctacagttcatgtgcctgtttccgtttttgctgctcaaagccatggattggtgtgtagtcaggacctgcattctctgcttggtggttcagtgtctgggatgatactgtttcccggttactctagagcagaggtcaacaaacttcttatgcaaaggagcaggtagcgagcatttttggctttgtgggcgacacaggctctgttacaaccactcaactcttattgtagcacaaaagtagccacagacactatgtaaacaaatagatgtggctgtgttttaataaaactttatttacaaaagcaggcagtgtgccagcttgggcctgcaggaccctggttggtcagccctgtgcctgagtgataacatgctctttcatgcctttaaaaatgattattaaagtgtgttcattatcctgttctttttgtcctttttcttgtttaataagtgttcactgattttaaaaagacatttttctaaaaatctgggggttttttgtgttttttttgtgtgtgtttttttttttttttttttttttttttttgacacaaggtcttgctctgtcacccaggctggagtgcagtggcgcaatctcggctcactgcaacctctgcctcctgggttcaggtgattctcctgcctcggcctcctgagaagctgggattataggcgcgcgccaccatgcccagataatttttgtatttttagtagagatggggtttcaccatgttggccaggctggtctcaaactcccgatctcaggtgatctgcccgcctcagcctctcaaagtgtggggattacaggcgtgagccacggtgcccagcataaatttattttcaaaggcaagtgtggtcagtgtaggcagggagtgaaacatgtatgcgtaaacacaactacttgaaagagcggtgcggtccttcctcaggcccccgtcagctctgctccatccccagtcccttcctgtgcctgcccaacctgtcctccatagccagggccccccaacccaaacccctccaggcaccacctccctccatccctcccgcctggctctggggagggggtggccagcggccctgcacgcttcttcctcttttctcttcctctctcttcagacttgatgcaaagagtgggctaagtctgtgctgactgttgccctggaaactcttttgaacctttctctttccctccaaagattccgagttcctcctacagtttgcagccttcagtaccctgccccttccctcccctgccctcccttacttggttgtctttattccaagttaaatgatcatcatgaggttgggaaagccgcagctttctatgcaccatgttttactccccaaaggacatcttttagagtccgcagaggcccacatgaagggctcaccagcagctctaccggtttgctttccacaaggagagctaaaatgccggttgctaagcagcatacatgccgctgcttctttccacaatgtagacttaaaaaaatcgccgtaaacattttaccatatgattgagtcaggtgtggggagtcgcagtaaacattttaccatgtgattgagtcatgggtggggagtcgcggaaatacacagggcaggcagttcgctatcacgatgttctctctcaattctgtctttggtctgtcttcctgggtaatgtcacatggagacccaggggatctgccgtcagctgtgtgcagtgggttaacaagacgacggggaacttcagagtgcaggcagtcctcatcttttgcagattctgtatttgcacattcacctactcactgaaatgcatttgtaaccccaaaatcaatacagcggtttcacagtcattctccgacacgggcagaggggtgaagatactgagtcgccagatgcacgcgttccccgccgaggtggagcgtgcaaagctctgccttcacgtttggctctcatatcgtgcacatgtgtcctttttgcagtctccttagcactgtgtttttcatatttttgtgctttctgatggttattttgctgtaaacggcccccaagaatggtgctgatgtcctatttagggtccctaagcacaggaaggctgtgatgtgccttatggagaaaatccatgtgttagacacacttctttcaggtaggagctacagtgctcatgggggtctagtgttaatgaatcaagaatacacacacccagaaaaaggaagaggaagcgcacagggcagccagcttgatgtcaccacgttacatccttttatccggtctttggtaagttttcttttcttttttttttttttgagacagagtctcgctctgtcgcccaggctgaagtgcagtggcgcgatcacggctcactgcaagctccaccccccgggttcacgccattctcctgcctcagcctcctgagtagctgggaatacaggtgcccgccaccacgcccagctaattttttgtatttttggtagagatggggtttcaccgtgttagccaggatgttcttgatctcctgacctcatgatccacccacctcggcctcccaaagtgctgggattacaggcatgagccaccgcgcccggccggtctttggtatgttttcttggggacttacacagggtcacgtggagatacagggggatgcgccttcggcccatctgtatgtggggccactctggaaagtgctaaggtaacagctatagtacatgaggaagccatggaagagatgaaaagtggctgaatgtgtggattcatcagatgatgagaacatttaatgtaatagatagcattggtgtgaggctagacaccaaagaaatgtacaatcatgttacccaagggaaggaaagtattaaacccttcttggctagtgttttattttaaagaaataccaaatataattcattattttgaagaaacgtattaaataaagcatcttattaacaaggttacgtattgaccagttgaagaaacttttgtcatcagaggttcacagaaacctaaaccatacgttaggttggtgcaaaagtaattgaaatgggccagatgcagtggctcacacctgtaatcccagcactttgggaggccgaggcgggcggatcgcctgaggtcaggagtttgagactagactggccaacatgggtgaaaccccgtctctactaaaaatacaaaaaattagctgggtgtggtggcgcgtgcctgtagtcccagctactccggaggctgaggcgggagaatcccctgaacctgggaggcggagattgcagtgagccgagatcgtgccgttgcactccagcctgggcaacagagcaagagtctgtcttaggaaaaaaagaaagaaaaaaaaagtcatcgaaatgacagaaaccgtaattacttttgcaccaaactgtatttcccctaagaacaatggcccagtatttacaaattcagtgttcacaaatattttatagaacacagctaccatgaataacaagagctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactgcgcatattgaagacagagcccaagacgcatccaggtgcaacgtctctgctaagaatgtgtgccaggaatggggcctggcttcctcgtcgagtgcggctgtccgtgggtttctgctagacagataacgttctgaaggagttaaactttcacagctcctcctcctcctcctcctcctctatatcccttacctcgccacgttcatcactggtcattttgctggaagggaagccctggtatattcttacattgctctggaagtgagctttagcccagcgtcgccaaacttacaccttaattgatcccagatgagaaggaaaagctattgctcttaccccacagtcttccctccctgaggccagaagcaggtcacgtgtaaaatggtctgctctctgctgacagtggcctgagtctcccatagtgtctgctgagctggatagtccctctccagggagctttgcaggggatgggtgatgagacatggacatggggacgaattcctctcatctggaatcgcagacacagcatggagatatgagcacgcggcatgggaaataggcttcctcagcccttcaggatcagggaacgtgccagagatgcaatgacatttggcagcagttgagagtatgagtgctgttgatgaaataaacagaggcctttaaaagcaaggcaggaaaaatgctgggacgagtacaggaacagaaaaccagccatttctccaggtctattcaaagacgtagcaacactccctgcaaaccccagggcctcattatcaccactcagggcagtggccccgcacagcacctgcacagttgccagaggaggcctctctataggaagtgctgctttctgttgtggatagagtgactggctgggcctctctctgtgtttctcccctagtcttcaggaatatgaatgccttttccttcagtgctactaggtgcaaatatgcgagttaagggacaatgccaataaagtagccgcagtttcctggctaaaggaactgtgcaggtattaaaaacccaccgatctttaatccaggttcgtggcagggggactcctttttgttgcaagattgtctgtgtgtggaaaccctggagaaaggccacacgtgcagtcagcaagccgagtcaccaggcacagagccctttctcctgatcccctcctcttgtttctattcccaggcctcattatgtataatgtcacagacacacacgcccaggaacatcccatcacagccaggacagaagcgccaagggaggtgctttgcacagattccatcttggagttagaagcacttgctcggtgcttgccaactacaaatagccccatgctggaaaatgatgctaattagtatgccattaaaaagggtggggggaccaccacccacaacaaaatggccgtgtgcaggcctgaagccctgccctgagggccacagggaagcatggccgctaatgcagcctaattcactttgtttggcagagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaaggtaaggagctcgcggggtgggggggtggtggatgagggagcctttggagccgtgccctggaacagagtcagaaaaagccaaatcaacgttgccaatcccccagcatcaggagatgtgacttggagctgacaacacgtggctcagggtccactttggggcagggaaaccttggggctgatacaaagtcatgtcacctccccacacctggtgctggccctggtcacccagcctggacccctgaccggaagcacttggtccgctttagagagtacaaatggattgctacctcaagaggaaaaacgttggagggatggaaaatattgtttttctcatgcatggcctcggtcctgcgtaggtggagactgtgtccttcgaaggcttggcaccaaagaggttctcaactccctgctctcagggcccctcccctgctgcatgtccaggagtcactccctggctgctgcttttgtcctggcaattcagtggtttctggatgatactgagtctgctggacatcgctgggctcattttctcaggcagaggccaagccaggatggtggcagggtggcaagtagttgagaaaaccatcatgatcgtggccactcagtggcaggggcagctgctgaggtgggggcctttttcccccttctctgttttgtaccttttttatctttaaatagcgtttcttaaccagagttccacggcacagggtgccaaacattggtgagccagcagcccttagctggtcaggcagggcctggatggtcaccccctttcctgagcagctgtttccccagcgtgccacacggggcttccccttcacaaatgcagtggtgatgtgacaccgggcgcgcgggcatggcaccccgagtggcccacgtgcgggaggccaacgggggtggctgtcagtagcctgtgtcgtcaggggccttcaccacttgccgcgcacagctgggctcccggggaaactgccacggaaaggccaccacattaactgccgtctcactcacagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggtaggcggctgggcgcagggacgcgggtgaggagggcggcaggtgggcgagctgcccaaaccccactgccagggtgtcccgtgccctggggagggggcgtccaggcctggcctctccttgcaggtgggcgaactgcccaaaccccactgccagggtgtcccgtgccctggggagggggcgtccaggcctggcctctcctttcccacggcccggcaccccgcggggctccgccggggacatcaccgcggagggtttctctgtgagaaactgccctactgcgtgccgtcatcaggcttagggccgtgaatcccttggcgctcagcagggtggaaaggcgagggcccggatgcaggtggcagcatgacccgcacctgctcgctctgggggcagcctggctcttcgccgtccattccctcacccctgcccctctgttcaacaaccaaggatcctgtggacggtttacagcctgttgagggatcaggtgagggtacctaccctcatgacctggtggcttcagaagcccctcctgtgaggttggtggcctgcaagaccctggcagcctctctcagggatgtgggataacgcacagattgtcccattgaaagtggaatggcgaggcccttcctccacctccaccccaaacatatttgtggacagtcatgtttgcacacctgccacagggcctgcagtgccccccgccacacacaccatgatgcctgaaatgcgtgattttggagaaagtctttgccatttctttttttcctttttttgagacagtcttactctatcgcccaggctggagtgcaatggcgtgatcttgccaaactgcaacctctgcttcctatgttcaagtgattctcctgcttcagcctcctgagtagctgggattacaagcgtgcaccaccgtgcctggctaatttttctatctttggtagagacaaggttttaccatgttgaccaggctggtctcgaactcctgacctcaagtgatccgcccgtctcagcctcccaaagtgctgggattacaggcgtgagccaccacacccagtcagtctttgtcatttttaagaatctcctatcaaaaggcacgtactccagaataattaatatataaagcccacagacttgttaattggagtcttgggtggcacatgacagtaagttatgatgggcaaggagaagaggacccgggtcagagctggtggccctggaggtcttggggtaggagaaatgaaaggatggtaaggagagaaaaagacagacagaggcaaaagttcccaagaacaactgaagctacttgagaattttgcctggaatcatctctgctcataagtggcttccaaagaaattacccctgctcatcctttaagggcttaaaaaaaaataaatgaaatttacgcagaaccccacgtgcaattctgtggcttggttgaagccagggcggccgggttcctgccctcctggcctgtctctcccctcccgctgcccttctgtgcaacactaggctcttcacatgctctcagaagccaggtccctgcagggatccgtgcccgcagcatatgtggaagtaaaagatggggtgagacacagatgtagggcttcccctttcctactgctccagcaactgccccacaggcttgttctctgtcatggggtggcttcttcctgttctcccaccacaggcgagcacaaactctggaatgttccaaatgtaagggctgtggtcagtgaacattataaaccattcctcttcctagaatcaaagaaatccaccttaagggatggtgtagttatgcagatgtagttttatgatatagacagccccatccgctcccctcatcacagatcacagaacttggccatggggatgttaggctctaagcatggtagggaatcatcgtggctgtcagtaccttgacatctttatttgcctggggggggggtatgcttcagtctttgatacgctttgactctgctttacttcacccctcaatctcggtgacagcacttggagcagaaccccatttaagacaagttgaaaaggaagagccattccgtgtaacgtagcagcttctgtgtcttatggccagggccaagggcattgaaacgtattgatgagagtaaaaataacaagcaggaaagcatctgccggccttcccagtacctggttaatgaactcttgttattctaatccacgcagcctcggtcttcaaagtccagatgactgtgtggcatcggctgcgtggccacgtgtgtttcagtgtcccacagtgctttcatggactcaaatttagtgccttgcgtctaccagtccatttcattatttccgtggctttcacaggtttttgtttttttccccaagacttttattgtttggtttggcggttacagtggagtaaagaggaagaacaatgatggaaaaacaaacgtgtgaagtgactgcttggcgagcaggcagcaggctctgcatacgcccttgctctgggctaagtgctctcgtaaatgctgtcctctaggagcctctggttaggtaaggctattggaggaaaacagtgtaaaattaaaatgccagggcaggtgctagaaatggatttcatgtggaatgtcaagagcagaagacctttgtgatgagctgctgtagatccaggctccatgatggatgtggcagtggagatgtgctggtttcaggttaggtgaccttgtctggcttatttatgattattattaagagaaacggtggctgtcagacatggtcagcataaatcaaaagcaacttctttaagagaagctataaaactcctccaaggaaattcctaactagatggctagagtttacaattatgagaggtgtttggaaccagagaggagacatcttttgtctgagatggcttttgaatttggaatattttaatgcttatttccttagtaaaaatgaactagaattattgggaaaataaccttgacctctctgattccttggtagtacatgtaacagcagaaacgaccaaatatcaccgtggttccttcttgtcttctcattcttggaggtccatgttgctgaggagtgtgcagcattgggcttgttccaccggccatagcagggtgcagtgaattaagttagaaagcaggaggaggcttagaatcttgagctgtgtgacctttggggaataactgtcctctttgagcttcaattttctcatatgcaagtaaaacgagaagattgataggtaatagccatggtctctctgctgcccacatcatatgagactatgcagataatttaaataatgttatggtcatgtgatgtcttttccttagagcaatctgtagtcagtggggtttattttcagttgttcaacattgaccaggtatcttctgtgctcttagagcttggtgatagtttctggtgtgtgggtggaggtggaggcagccggcacaggggacaaggccactgtaagaagtttgtaatctaattggagagaaagggtgaaaagcgtggaatagagaacagtgaactgagtgcattcccagatgctgagtggggtagtgaaggcccaagtggagagagcatttagacaaagcaggatcctgcaaggcaaaggctgcagagaaatgtcgggattgagcttggtccgggagggtgcttacatcgggacaggcagagagggcgcagggcatcgaggctgaggcagggatgggactgcaaactcccagcggcaagagcctggcctgtgggcgacacagcgagattaactcaaggagggaccgtcccagcaagcagagcaagacgctagcaaacgcaagccacagtcacacccggaacaaacacaagccacagtcacacctggaacatctgggagctacaagaacagtacacattattctatattctacatagttctaaaagaatatcagtatattattgtagttggcaatggggagtcattacaggctcttgaccaacaacgtgataaggtgagagaaatgatgttgcttttattgatggattttcattgcttcatccacagctccttgccagcccctctatggtcagcaagatgaaattgtgtatagcccagagccaagaatgagcccaggagggaagggaatgtctgtcctggccagtgcacatatcagcagctgaggatgtcaatctgtgatacacagttgatgccataattacaccagctgagcccctaccctgagcccccagtcctcgcgctcccccgtcccctatcatccattatatgttatgtcaatcctattttcttcctccagtctcttaacatttcaccctcatcctggtgtgttacttccttggattctttcccttgctttccttttcttggactggatggggaagtctgacagttagatgagcaccttggtctgaattaaattcattcccaccacagggaggctcagcaccagaaaagccctggagtgagggagggtctgcctgaagagaagcccctcagggaagcatggaggttctggaatgctccagaccttggcccgcctggacatgagcaaggcctgttctgcgctcgacccagcctgcttggtgcccagcactgggctggtgcaggttactgttggatattattggttgattcattgatgggctggttgcttggttggcggcacagtcctgaaagtttactcatgtttattttctgtgtatttctcatatcttttcctgctggtgctaagtgctttaagtgttgagtctagtctgctactttgtcattctaagcgccagaccctgtgcctttctcttggtgctgagtcaacattactgactgatgggcctgtcttgtgagttgtgacttgcacctgtagtgaattgagctcccaggctaccaggttcagttcccagggcgctgcacaaaaacttgtgactaattgctcctcaccgagggcaccatggtttgctctgccaacctctcctattcgtttggttctcaggcacatcctggttttgttttaataaattcaagcagcacagtgatcactggcttaatgaaaaccagaggaaggcaagccgcttgctgtcagacttcagatttccagaatgtttctaagcgaaccaacctagagccagttgagaataggttcagaatgagagcctttttgaatacacagttgggggaaaaggaggagagtcattgattctctcagacaccaaggaagctccttagaatagaaccccaaagagagtaggtggcgctgatgctgtgagatgacactgtggtcctaggtgcggggttcggaatcgcagagaacacgggaggaagcccaggctcggcatcgaggagagctttgtggccctggagaacctgcctctttctcatccccagcacgggagcacttgccttttcagctaaaacatgacagcaggccacacagccagcatcgttcttcatcatggagctggccccttcctggtcaacaaaatcacatggattgattcacattctctttctctctctgctctgatatctacagttcctttcaacattagtgcctcgtgcttttttgactgtcttcctagtgcctactctttgaatcagaatgcagacagtgggcgatggagcgaaagccatgctggagggctctcaggagcaggagtttgggaatgggcagaagcatattccccagggggagctgagagggctcagcactcagaacacccatgtttcccaacacttaacctcagcagcagcatctgcagactcgtgtggggacttctgtctggactcagggatgttaagagtagaaggcccaatgtcagcttctcacgtgggctgtcagcaccgcagatgataccggaagatggactgtgatgggccagcgacccctctgactgcacgcagctgtcagccaggcctggaacaggaggggcgagggggtgggctcagcctctgttagtgggagaggtcctggttggaagtttcactgaagtatcagtgttgactttctcaggtcaaatctgggccatttcatgcggtaaatccatgtcggcaggtatcagcccaagtgttttgaacatgctgcacttgtacatgcctggaccaaatgccaggctgatgagcagggaggggttgaaaagcagaagggagcccaacccaccggcgtcagcaggaggctggccctggctgtggctccccgatcagacaggcggcgtccaatggggcaccacacgactcccgccagggtggggcttcccctgtacctttcttagagctgatggtcccctgaccccactcgcagcctggaaggaggggatccctggcagagaccgggcttggcagaaaactgggcatctgcttgagaggtggaaatgctggagcatgcagaaaatctaagaacccttatttatatggggccccagaccaggaccctcgggtcagtctttctttgcccagggatggcatagcagtaacatcgcttcctgtgccctttccagtaatgtgagggcaccatctccgcccctgaactcccttcaggccacttcactccatttcctcagcctgaccacattacccctgccccagtacttggcttccctcaccatcacctaagtgaagctcacatgcacctctggagggagacaggcgcggggagagggagcctcagctggaggtgcaggaactgagtatcaatccattcacgggattgaggttctggtacccaaattcagaattttacgaaaatccaagacacttgttcattcgtgtgcaggaaaaaggtattcctagcccccaaaccacacctaacctgacagtgggcactcacttcaccttgagagggatcgatgtggtgaggaagttcaaggttgctagatggcatggaaaggaggcaatgggaaggaagtagatacccgccaggatatttctgtgaagctgttgtagcccagtgaaatgtcactctccaggtgtttttaccttctctactcccagctcacacggtgccctggcacgggtattggcaggactctccaggtgtttttaccttctctactcccagctcacacggtgccctggcacgggtattggcaggactctccaggcgtttttaccttctctactcccagctcacacggtgccctggcacgggtattggcaggactctccaggtgtttttctctactcccatctcacacggtgccctggcacgggtattggcaggagatggagggtggctcttatccaagacattttcccatctgatcatatcccatccgcggtagccaggctccaagatggcccccatggtctctgcctcctggtgttcacacccttgtgtagtcccctcccgtatttaccagagttggtctctgttgagtgaggtaaggcagagtgatggtatgtcactttcaaaagtaggttataaaagacactgcaccttctgtgctgggtgcccctcttgctttcttgggtcattccctctgggggatgccagctgccatgtcataaatagtcctgtgtaggagaggcctgcatggcaatgaactaaagcctcctgccatgatgacatgagtgagcttagaaatggaagcttcaacctcagtcaagccttcagatgagtgcagccctagctgacagcttgcctgcgactccgagaggctctgagccagaaccacctggcaaaaattgctcccagattcccaacccacagggatatgtgagatcaatgtttgttgttttagccgctgggtttggggtttatttgttacacagcagccatttggaagctagagttgaggcacacagaagctaaacagtttgccaacaaacagtcagctagcttgatcagactgatttaaaagaaaaaaacccctctgatctggtcccttcccagggtaggtgtctcacgctaaggagacagacatttgctttattcccgtggtcgatgttacttagtttcgttagttggggcctgcactttgttggaaactaaatgcgattgtgtatgtgtctacacaagatcaaatctgggctctaaaaagtgaggttttggccgggcacagtggctcatgcctgtaatcccaacactttgggaggctgaggcaagtggatcatttgagatcaggcgttcgagaccagtctggccaacatcgtgaaaccctgtctctactaaaaatacaaaaaattagccgtgcgtggtagcgggcgcctgtagtcccagctacttgggaggctggggcaggagaattgattgaacccagcaggcagaggctgcagtgacctgagatcacaccactgcactccagcctgggcgacagagtgagactccctctcaaaaacagtgaggtttaatatgaagcaaaaggagctcggagcccagagttcactccatagagaaaattaacacagcagtgagtgccccttgttgtctcctggaggaggcatgcttcagctggcatctgctcatcaaaacgtcagtcccctgtaccatgcaagagtttagtctccattctgggagccatgtgcttcactaatacccagggtctcttctgctgtgaaagaaagaggatagatactgggagagaactagccgtcctcgtcacaacgtgtgaagtgtgtgaaatagtaccaggcacgtaaccagtgcatgtgagtgctactgctgctgttataagcaaataaacagtgttttctggaactcctgtaatgacatcaaatgctaggaccttttgacctatccatgctgaggatgccccctaggctgcgtgttttacaggtggaaactaggaggcggttctaaagattcctcagggagtttgctgagctaaagcccaagtgttggtttaggggagtagaggtggaggtgggtggtgggaagtgggagtgtttagccctacctcagatcctggggtgcttgtcatgacctcctctgttacatccacaaaatatttaaaagattgaaattcaggcttcagctgaatttcagggtgtagtggctcacacttgtaatcccagcacttcgggagattaaggtgggaggatcacttgaggccaggagtttgagaccagcctgggcaatatagcaagatgtcgtctctcaaaaaaaaacatttaattagctgggtgtggtggtgtgcacctgttatcccaactacttaggaggctgagacaagagaattgcttgagcccaggaattcaaggctgcagtgagctatggatcgcaccactgcactccagcctgggcaacagagcaagaccctgtctcaaaaaaacaacaaaaaaattgaaattcagaaagactaactctctgggcttatccccctcctcaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggtgaggcagcctccttcccaccccctgcctacgtggtggcagctccccaccaagcctgagcaggtgctaggcagggccctggggaagaaaactcagacccgggcttcccagcgggcttctggcatgggtggtgggaagggggcttctgtcccagcaaagggcctttggacagaggccttggagagagccccatgtttctcttcctgaaatgttttaagggcttcaaagccaggggtcgggggctggtgatcttgggggcttttctggctccttgaggctcccagtcttaaccaacctttgtccaacttgaacacccaccacctgctttctcaacttaagaatggcctgtcatagtccaaaaatggtctgtcatagtccaagaatggtctgtcatagtcctaccttgtgaggtgtctgaattgaggtctgtcaagggagaatttggtggggatgacccatgtccctcccacacgtctccaagcccagcctgttttccatcaacgatactcacaggtgctcctgtggtgtgggctgggtgtgagcagaagggccctttctcctctctgtctgtgtgctaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatgtaaggccggggtgccttcccacccttgtgactagtgggttcacctgctcaaccgggctggcgtgtagcccagggtgacagtgacacaggctgtgtcctcgtcctcagtcacaggatgcccatcaaatggaggaagttgcaccgagcgagcagccctactcccctggggatgggcgggaggggccgggacagcagaggggtggtgaatattgctcttgcaagattatttctacgtgtctcagtccaaagcacctgaaaatgagatttttccccctgcgtgtggcagaagatcacccagacatgaaggctgtattacaaatctcctaggccacaaaatcacactgcatatctagcctgaaatagacaagaatttatagagcccttaaaaaggtagagtgtacagtcctcgaaaagccacgcagagaacccagaaagcaaggaaaacatttttgagtggaaaaaaaaaaaaaaagacagccacagtgttatttccatttaatagaaagcccaggatgaccataaccatctaataacaattcaggacaattttgctctctttgaaaggtggattcaattgtcttgtcttattagttcctgaccattccatttagcacaaaataaaacttcagtctggtcccagctattacacggatataggagctaatgctggaagactcagtctgtggggtgaaatacattcctgccattcaagttccctctgcctccccttcccatccagccctcagcctccggcaggcctcctttgtacagcccctcccctgcactgccccaaccctcttccagtcttccccagccagtgtggagggcctacaggtggaggctggaagcttaggtttatgttccaaagcagctggttgaaaagatattggtgtgaaatggtcctgggtgaaggtgcggaagaaagtggcaggacttgtcagcctcccagctgtgccttccacatgtaactgcagtctcgcagcagctgcctctccacagggataaggtgataacaacatttccctaagtactcattggattcttgggacagtctgtggagcattctataatataatattaagttgcagcatttgccgctgtggccacaggcatacagacctgctttggctgctggctttctcacatactagctgtgggacctcaggtaagacacttaactctgagccttgacttccttagctgtaaaatgggaaaaataatggtgactacaccatagggcagttgtgaggtataaatcagttcccgttggtcctcttggtgcttactacactgcttggcccaggatgagagctcaggatctggtagtaattattactattatcccaaagttcaacaacaggagacatttcctggccaggcacggtggctcacgcctgtaatcccagcaccttgggaggccaaggtgggcagatcacttgagcccaggagttcaagaccagccttgacaacatggtgtgaaaccctgtctgtctctaccaaaaatacaaaaattagccgggcgtggtggcgggcacctgtaatctcagctactcaggaggctgaggttgcagtgagccagagattgcgccagaccctgtctcaaaaataaaaataaaaaacaggaggcatttccttcgtgtctgcttgcatgatgcactgaggagttggatcttctgttagaaatttgagcaaagaaagacatgaactagtcctgcgagggcctttcatcgaaggcgctaatggggagggcagacaggggcgagggcgctggttactgtctgcgcgtgacatgcgcacggggcgctgtgcttatccctccccgctgcggatacccttttccttgtttcaggaatccctggccacttcaagatcccaggggcctcctttcagtcagtcagttctctctccttcatttttgctattttcattaacattttattttcaagaactgtttatgcccaaggcagacttgacttgaaaattatcttcatcttacaaagtcagtcatatttttcccaggatgggaacaagctgaaacatcaatacatatgtgtttagatgcttccaggaaacaattgcttccttctagtctttgtacatgtcaaaaatcactgtgtttttgatgctgagaaagaaaatgaacagaaagctacatgaaaggggaaatatatattgtttcttgaagatgaattgaaaacagtaatgaaaaaaaggatcaatgagctgcctgctgactattccctgtgggcatgaggcaggggactggcatggaaagatccatttttagttctattatttcttcattctgatgccacttttaaggttgtccagtaatgtagtctgatgtggtcatagaatgatgtctccttttgcttttttgttttggtttttaaatattaaactggtattcagggccttcggtctccttccagctctagtcctggttaactgtgtcagcctcagtgagtcacgtcactgtccagctctcagggacctcatctgcagaaagaagacactctgcagacagcggccactctaagccccagtgtttccatagcacggcatcgttttcaaatcaagttcgtgttcattattatctcattttattcttcacagcaactcaaggcaggcagggcaggcagcgtaggagttactattctcacatgcctttaaagacactgtcagcagaggtggaggtcccagagctcgtctcttcagagcttgtctcgtgcctggggttccagggccatcccaccaccttggactgctgtccacgcctctcctcctcgtactgggagcctgctggacccctggacctgggccaggcagcccatccctctgcccggccacctctggacaaagcaggggacttgatgccagaggggttgatcccagatacctgctcttcaggcctggaatgatacagactttttactctgtgcaggcctgaacatcaggaaaggcatctgggttataatccagaaacgtcctttcatataaggaagcagaggtataaatgtcactcaactgagacccccaaaagggagggactctccccacctcaacttgaattatttacttgattgattgatagtgaatagtgtggtagcgtctctcaaatcctgggatccatcctggatcctccatggctggaggtagggggagctagaatgtcaccttattggtcagtagaatctcagaaaaaaccttaaggatctaaatactggtaaagagtgttcctttcaacccaaaagaggccgagaatcaggcaggagggaactctgcagtggcctaaggcaagcgaactagacctttagaccaaggggtagatgtgggggtggcagctccaggctgagccgtcgggagttgcttctcaccctgtttgctctgcgtctccatcaggctcttcctctcttgcagttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagagacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttcccttttgccctcaaatgcagcatatcttcatgagcctatttatttccaagctaggctgtctttattaaccaacaactcagccccagccactccccaagcggggaaaaaaacactacgtttcttggtcagtgtacctctggacactgcagcccacacagctggctgaactcggtaaatgggaaccgaagtcttgtgagcttcacatgacctgatcctttgttatcagaacagggttcaggtggccctgttggctcatgtgctttggaagccagctccctgggtcacgagtctggctttgcactttccataagagtctgcttctatgcaaaggtgcaaacaggagacatgcccaaatctgctggctgaacaggctaaactacagtgagaggctgctctggcatggctcgttcttccttctgtgtatctcccaagtctgacaagtgtgttgccctgggaagcaggacctccctgagctccttaaccttgaccccattctgcaggacagtcgcatgctctgggctcgcctctggcctcaaagcacttgtgtaagtgggcttgcttaacagtaatatccttggaggcttctggacccaaagggaagccaatccttcgagtttgccattgggctgctggttgctggtttcaaacatatagttcatgaaaagtctttaattggagattttcaaaggtgaatattctgtttttgttggaaagaaactcatctgatgagtcatcgatgagtttggctttcgcccctgccacatcctcccctgaggttccttccatgctgcactgccttcctttagccagtgacagagcctggtgcccttcctggactgaaaccgatggaatccttccgaggggagtggcattcggcttgcctcctgcctaaatctgcttttatccatttgtagcaactttatgctgtaacaaaaggcggaaggaaaccaagagttctcttagcaagtcagactccttcccaagatggcaatcacagaacacctcgcaggatctcgcaggccacggtgaaggagaatgctttatgttgatgttgtccattctctctctcttctctttgcttttttttgacctaaataagctgcaaacatgttaatttaccaatattgataaaccacatgaagaaatcaggcattttacgttatgatgtgcttgttcctgtctctgcctataaattgactgtattgatgatgaaggaaggagttccggctgaccattctgaagcagtcccagtcacgggaggatgccttacccagtggccagacatgatagttccaggtctccccttggttttggtgatagagaacccaaggaggcaagggggaatatcaacgaacccatttctatttcattacccacaagcgaaaggactagaaaaaaatatttgaaattaacatttagatgcataggtctaactccttgtgtgaacctgtcctcctcaccccctgctccaaatatgtgaggtggaagcattagcagcggagcaaaactaagatctaagaacgggcggtggtgctattgtgtccctgggagtcactccacgtcgcattgcacggtggtgctgaggagcgagagtttgctttatcatgggctttcagttcccacctgcgagctgcaaactttgatcttgttgtccttgaattcccctctacatcacgaggaagctgtctctttcatctcttccggatttggaatcagaacactctgcccgttgtttattcgccagttgccattcttaacatgggggagcattaagatgcaaatgcagagatgtgtcctgtcttgacaaaggtgggaacccctgagctggagaaggggctcctctcatgagaagctggggtaaacagccaggcatcgcagcgtggggaattagacaggcaggaatctggcctggtttgtcataaattagccttcaacttgaagtctattatgttcttataaggcggtagtgacttcagtccagccgcatctaccatccagggtggaggttcaaaaagtcttatacgcacctacaagtctcacgcttgctgctcagactttctgataaaatctcagagttctgtttgtattgaccaaaaatgcagttgtgcccacttgggtgtgtatctcatgtccttgtaaaccagccaccttctttggatagaaggcaaggctgacaaatctgcagatttgttcaatgcaaacacagccgtctatatcattggccactgctgattatattgagtgtttttaggttttttaggtttcttattccaaaaaggattttagactgtaaaatgactaaagatgagttaatttccaaactaaaaaaggaaggagtcctgcctgtactcattgttctttcctgctggactagtaacccattcttggagcacacacagagtccctcgcttctaaagacaatacgtcttaaaccctgaaaacttgccagtgagaaagaggttgaaagtcctgtttgctattagttgaggctaagccgtctgctgccactgtccctggggcctccatgctgccgccggggtatgtggcccagctgtccccccatgaaggacactcttcaatgccaccacacgggagtctgggcagggaggaaaggcacacagcccacttttctctgcaccaaatgaaacaaagctgggtgttcagtgtcactgatgcaagtaaatgggtctcaaattttggtgggggcagtgtttctttggattctgatacctctttttccacctccagaaagtatctgtcaacattggtgggtaacagcttataaagtgcatcacttagtaatcttcctgacaaaatgacacattttaaaattacaacctgttcattatttccatcataatgcaagcgtaattctaatccgggagaagatactgtcatttaagctcatcttctcaaaaaaattttttctgaaaattcctggaaactaatttatccctccctaaacaaacacattctgcttttgggtggccctacccagaacctgcagcaatgtcataacactggacacagtgcggcttggggcagtatcaagccttcattgcatacaaaccttaatctctaagcatagttgttcccaaggtccacacgtgtggaggcgagtactgaaataccacactcacacatctattccatgcgtacctagaaattaccttcaacactaaaaaaggttccttctttcattccctatcctgctaacagcccacattgtaatatttgatttatgaagaagttctaatttatttgtgaactcaggatgttgctttacagcattgctcgtgttctctcatttacttattatgcatcacggttggaaatgctatccacgtgccgtgcatcgaggtggagatttgctggatctgtctgtggctatttttttccatgtttttctcactcaagcaaagtctgttagtggaaacatgggctgggggatggggagaggacagataaagcaagagaatagggattagggtccaatcctcaatgcacagggcttagttcaaaatctaagctgtttctgtagtaagcagccaaatgggaaagatcccttcgttttgaatttgatgagaatgggcttggaaatccacgcccaccggcttgcacggaagaggactcagcctcttcctaatggttcaacattcaattcctgaggaaagtgctgatagtattagttccctacatttccctaagactcccatccaacccctagtgctactgaagagggtttgggaaagcaattggagttccttagcttggatatatatagtacctgtttttttcctctggaaaaaccaaagtactttagtgagtcttacaatcttaaggcattttgtcccctcactgggtcccgagaggcagggaggggctaggccttgagctaggagcaaggacatgggccgccaggcctggttgttactagctgtgcaaccttgggcgagcctcttcgctttgctgggcctcaggttcccgagtggaagactgggggtcagaacagctgcccttctgggagagcatcaagagaaagtggtataagtgatgggaagtgctttgaagaaattaaaggtctgtctaggagctgggggtaatcatttacagatgaagaaactgaagtctagtcattgactggcccgagttcacagagtggttttatagcaaaacagggacttgagtccagcttattggattcttcccatcagatcatattgcaccaggtatgtgtagacatgaacacataccattcctctaaggtgtgtgtacatacacggatgtgtgtgtacaggaggtacctgacatggtgaaaggccataggacagaaaacctgagttctaattccagctttgccagtcgtcccgtccgtgatatattccataggacagaaaacctgagttctaattccagctttgccagtcatcctgtccgtgatatattccataggacagaaaacctgagttctaattccagctttgccagtcgtcccgtccgtgatatattacctaactcctccagaactcagttttctaacctataaaatgaagacattgtgctagatgatctttgtggttccttcaagctctggatctctaattccatgattagtaatgtatgtatgtgtatataaatatgcttatctgtagaaatgggcccatttgaaaagtggagacaaggtctgcccaggtgcatttattgtgccagaaacagtgaattcctaaataagttcataaaatcttgttttacaattcaatggtagtgcttaatgttactgtctgaaatccactgtttaaccagatggaagactggggccattcaaaacattattagttcacaagtgtttgctgttaaaatgcttcaataaaactcatttgttaaagtcagaaattcaactcttctgtacttgggcaggtcccagcagccccttggcaggctagttttgtgcatgggcctttgcaagctatataaacgttaggtgttggcttgattatgataaatatgagcaggctccctggagaacagtccagaaaaaaagagttatagttctcacaaactggtgacatgaatccattaagctgtgtggcattttccagtgtaaagacattgtttgctggctacgatctctgactttttgtggcatatgaggtgtaaaatgttgtcaaaaaagaatctggtgtttaaaaaaaaatcaaactatggtggcattaaatgttcacttttattcta

SEQ ID NO: 4 - DNA, 410076 bp, Mus musculus
  source 1..410076: mol_type = genomic DNA
agttagcgagctcggggaaggaggcaagttcccaccgccggctcggctcggcgagggctcgcccaccttccctgcagcctccctgcgtcctcgccgccgtcctcctccgtttcggccccgctagaggagaacgcgcgctggccgggtggaggaaaatgctagcgatctggatgtgaccgcgaagagaggacgcgtggctggaggaggcagagagatgagaagacccattatttgagaaccaccagccgttccaacctttcctgcaaattggtgctattacttctggggtccatttgctttcattcttcccaaccccccattaagaaatcttgacttgaggaccaacccctaccacgaggggggacgcgtctgggttggcagaccttttggatgtagccttgtgggaacatttagaccctttcctctggaagagccaccatgaattcggtagccggaaataaagagaggcttgcggtctccaccaggggcaagaaatacggggtaagttgtggcggtgtccacgaggagatgcgtttccagggactcatctgagtgggtgtcctctgcttcccgggagccggcggcggatgcagggtccccagctctcgggtgcaccggcgtccccacggccggcggggtcgtgcgtgcatggaggcgggtctgcagctcgcctggctacgggaatgtcttcagcccttggttcctccctttcctcacacccttaacttttgcagtatttcgggacttgcagacagagttaagccgagggggagcatttcccaggaattcctctgctcttccctcggatcgctgccctggagcggggagcccgtttgctttacctgcaggacctggggtgggggctgttccccgaatgagtaaacatccagaagtcacagtcacccaccctgcgatagggtgttctaggactgtgtacctaggcccttgctggggtgggtaccgggtttgaaagagtagggcgctggatttctgggtgttctcgcagaagctgcaggatatccacaccccgcaagctcttgtgctgaccccaggaggaatggagggggacctgcgtgcgggtcactctggcgagggtgggtgggacaggacttccttaaggattggtcacttgaaggatggagatagatggagggcaggtttgcatcagtgcgggcaggacggcgaccccccccccccaccagccctccgccgcacgggggactgatggctctacagggcctgacgccgcgcgtctctccggcaggtgaacgaaatgtgctcgcccaccaagccctcagcgccctgctctcctgagagctggtaccgcaaggcttacgaggagtcgcgcgccggcagccggcccaccccggagggagcaggctctgcgctgggctcatcgggcaccccgtccccgggctcgggcacctcgtccccgagctccttcaccggctctccgggacctgcatctccgggcattggtaccagctcgcccggctctctgggcggctcacccggcttcggcaccggctcccctggctcgggcagcggcggcggctcctcccccggctccgaccgcggcgtctggtgcgagaactgtaacgcccgcttggtggagctgaagaggcaggctctcaagctgctgctgccgggacccctcccgggaaaggtgagctactgcggggtgctctgcgggaagatgcgccccaccttaggatgctgcctcgaggcgcccgggtgtaaggcccctagctgagcacccggcttcgcggcgccaggggatgcccccagtgggttagccatacaggttctccctaccctgtctgcagcagcatgccaaagggggcactaacagccagctgctgcgagttccaggttccaatggcttatttgtggctctaccttccctgcatcacagaaacatattttccaaagccagcatttctctcttaacactccatgtgtctaagtgaggaagattaagaggtggcccgctgtaagagctgagctacatcctgacctgctcctgggcttatttaataagcacattggttcctccatagcaaccccgtctgcgtggtttgaccggcctggagcccccagagcggaacacaatgcagttgtatttgcacagttgggtccaagtactatcacatgataatatttactcatccacttcaaagagtttttatcagtggttcgagaaaaacatcaagaaaaccgcattactgggggggaggttgctgacactgctcaatgacattttctggtttatttttttgtgacttttgaaatgaaatattgtgattccgaatagcagggcttaggagtagccacatctgcttgcctcttctgcttatccatgcacacacatggatgttttgtataccaggcttcaattacacagacagccatagactgctgtaaaatttaaaacgggaaaagtcgctcccgggagaattggttttataaatctagaacttaatctcgagaataattaactctgggttattgtcaatttggcatttttgtcgttccttcattaatcttccaggacaccgcaagagtaaatctcagggccaggatcctctctcagccttacactgtcttgatttaacacctttccccaaacacagacctagtttctttttttccattaatattacttgatttcccaccccgttcaaagtacagcccctgagacggcaggtcctcttggacgctatccttctctgaggagagcttatcttctgatgaatccacagtccatcatgtatcctcgtctgtgtcaagtgttgcaaagaagggactgtggaatggggtgagagaggcttgatggatacacatttgagagatcctgatgcttgagatgtgacagtggctgatatttgtaatcctaataagtcacaggccaccaaaattatcttagaacattgaagtcacatgctcataggggttcttcgtgttgttgtttgctcctctggtgcaagagtaaagaagcaccaactcgtatcttcaagaagggaaggggtgcgggaacacagacaggaagaaacaaaggttgaagcttagctgcatgcgcatgcctggtgatttatggggtcatgcgagagacgggggcctttgtttttgttaaagccacctggaaaattcatttcacactgcttagagggcagtgccataaatgttcagattttatttattggatgaaattaaagtgatgtgaaactgatcatattgtagagggggcaatggctccagatgcagccaagtcctggacaggccaagtctcagtgcttgctctatgatccaggggcattgagaggagagctgtgagtctggggacggtcactgatctatacacattagaacatcatacacagttgccagagttgcagggtttagccaggaacaaggatgctttgggctagctcattgatagcgagtgagctatggagccttaatatgaaccacctactgattgtctttgggaagggtaactttggggattgtgtaaatggtagtcgctgtcaccttctaattagatacaatttctataacatctttaatgtttgcagcattgtaatcaaacaaatgccacgttgtctggtgccctctgcgtggtgggtcctgtccaatggagacaaggcatttcttctcagtgctagctttatgagcaaactgtaagtgctgatttatgagcggaacctctgtagcctgcaggccctgaaagagttaagtttcagtagaataagggatgtcattgtgaccccaacgtgtaattcgctccggagaacaagagtctgggaagataaagacatgtttttgagggataattagcaaaagtcattttcataattcacttaagatgcttaaccatatttggggaatattttcacaaatagagtattaaatcgtattaggtagtatgaaaaaccttctgcatagtcattcagaagtcagaggcagaagagcaggccctgaaattcgttacttaagaatgggtttggcttttttttttccgaccgatttattttgcaatcttagtgagtcagtttcacattttaatacaatgtgtttttaaaaattaattctttagaatctcatcccgttcttaacgttcccatcaacacagcaatggaaaaccaatggttcagatggttggagtgtctgtcacaaggcgaggttcaaaaagtgcttcttttcttccgagagagagatgaaattgacatttatctagtagacaatatcccgggggtttaaggtttatagaatcaggatgttgtaatgcccacggtcacgttctaatctgatgagttcacttcttcatccctctgctgtcagatgatttccctcaacatgctctattgctggtagcaagctctagagagttgccctccatttattttggggacagctggatgaggtggggtgatgaagtgttagacagcctctggaggggcatctggatgtcccctcagattgaagactgcctttggtgttccaagagttgctctgagtctcagcatgcccgagagtgtatggcgtctggaagactgggctctgggcttccgggtagaccagttagttctatgacactggaggatagggcttcatgttaggccattatgagacttggatgtagctgggtaaccgggtaaaggatgataatgttgacagaagcaagaagagagaaagatggtgatagtagtaacttgagtttcctagagagggcatcaaaagaagaggcagattgagctataaacctgattgttgcaggttatctcaaaacccagaaagtgaaacctctgctctgaattcaccctctcaggagcaactgaactgggcaaggagctgtgccatcctggtgtcggccgtaaactcttctgattgacttttactgcctcagtaagaaagtgcttgccagtttataacctttcttttttagcgttggttaagtggaagtgctcagataaaacagaagagtggggctgtggaaaagtgctgggtctttaggtgagggttgtccttttcccactgtcatgtttcactgtgtaaatataaaacacttcctgcatcgtggtgagcacgcctttcccgtttttatagacagtcaaggcagggagccagaaagagcagccaaggaacgaacctctccgttttttgagctaacctagatcattctgatagctgtgacagaacctttgaattgactgtggaaagcccacggcacatcagcctgaggaaattccctggagaaagcaggaatgttccaggttgggcaaaggttatctgacatctgcccatttccatactcacaaaagaaaatctcttatgtaagagaaaggtccagaactacggtcctatctgactttttttctcctcagtcacatattctgactccatctatgccccagaaatatcagcaagattagccagatatcctgagaagggtgacccaggaataacagggatgaaagagaagaatgtctgccgggttaaaaacaccaaacgtgagctctaaatagccagagcccaaggaagtctagactttgggagatataaataaatatttctgtattttgccagttccaaaagaggcaggaatatgaaaaataaccccatttaaaagtaacctcctaaagccattgtagtattctgtatagataaactagactttacatttgaaatatttactaatatttctaacaaaggaattccagacaaatttcccttactctaagaacacttctttataaagcactttcagaatccttttcattttgaaagtatttaaaaaaacatttccttactgggggcagggggcagggggactggaagcatggctccgtgtttaagagtactgggtgctcttccagaggacaggggttcaatttccagctcacagctgtctataactccatttccggggggggtgctccagcactcttcggggctctggaggcacaagaggtgcacaggcatatgtgcaaactttcccctcattttcaaatgcatgtgcagtgggatgtgatcgtatttgcctcccgttagctctccactcttttcctctccccaacacagtcccatcccaaactcaacaccctcttttatttatttattttgacaaccactaagtccagtcagtgctgcccatatgtgcttggctgtggggccatccaccggagcatgggaaacctaccagcagccacattctcccttccctaccactacccactgccaacagctccctagtatgagggagagctttgaaatcatctacctcagttgatggcctgaattctgtcagtcttggccttgtataagtcctgggcaggtagtcacagctgctctgagttcatggttgtgatagccacggtatctccagaagactggatttcacagtgccccttcttgtcttccggctctttgaaataaaggaacagctgatgcctagcaacaatgatggagaagtcctggagcatttatcatttaagaccctcagagccatttccagagtttatcaaaacattcccagtggagccaggcagagcccaatctcttcctcaacatttcattttgctagacttttaagagccataccaacatggtcagttttgggagtgacttaattcatttgaaagattccccggctagtaatcacccccacccccattctagacaagattattacatgacaaatgtgatttttaaatgtctgaggctggtagtttgtcagggtttataatgattaaggcaattaaaatttaggtcagttgctctttggtgtcacagaccataccaatcatctgctgataacacgatggtgagagcaatgatggatgattgacagttattgactctgtgtgccgaacagtgtgccaagattgacagacagtttcatagccaaataaagacgcgtgtgatttctttgtcttggagttataggcgattattgtggttattatggtcagtcacacacatgtacatagcacacgcctatgcatgcatgtacacttacacacataacatcctgacccaagaaaaggagccaatagctggatactcagggtcacatgcatacattagccttccctgccactctgtccccagagattacccaagctggcgagtggtgtggggtctctcttcccttcagtattattttaccattgtcagctcataggcacccttcctttccttatagcctgttgagtggtcccattgggttgaggaactcctcgctgaatggccactctggtgaacttcctcacttctgggcatcagcgtgaaggaaccatcatcattacatccactggtaaaggtgccaaaggtgggatacatctgggatccttagttttgtttggaatgtttatcgaaacatcatcacatcagtgtgcatatatcatccttctggctgttgtctctgggccttctcaagaaacccctctgaagaaaaatggccattgaattatgagtagaaaggcatccatcagagggattctctttacttccttaattaacgttttattctttttgtttttgaaaaagtgttccatttggtcttgaactcactatgtagctaaggtctatcccgaccaaacacattgcaaaggttatttttattaattattttaatttttaataattaaatggtgtagtattggcacacaggaaacagaaaaatattcaatagaaaacaaaatataggagttgtcctaagtacaactgaaaatttggtctgtgattgtagtagtgttttcaaccagtggtggggaaatgggtgttttattaaaagatttggggaaaactgaacagatcaatattttagaaaacaagaaattgatctatatagttcattatatacccagaagatctcccattgggtcagagagctaaatactaagtattatagaacagtgggcttatgctgcattcccagcctttgcaggcaaatattcctcagacatttccactttgtttagtgccttatgttgtgtccatgtgtgggaaagggtgaggagggtcagaggtcaaggtcaatgttaggtgtctttttttagcctctttctgacttaggttttgaacctgggtctctcattccaaagctcatcagctctgctggactgacagtggaacttcctgcccctgtctttccaggcctggggttacaggcgtgtgcctgccttaccaggtttgaggttacaggcctgcgcctgccactgtgcctgggtgctttactcaaactcagcttcttatccttctagggcagggtttcactgactgaaccatctaaggaacaggtaccataacctaccaagttctttaataataataataataataatgacttaaaaatgtctgagtactttatctgcatgtacacctgcatgcctgaagagagcatgagatttcattataggtagttttgagccaccatgtggttgctgggaattgaactcaggacctctggaagagcagccagcagccttaaccactgagctgtctgtgcagccctaccaaggacttctaatgcaaaccaccatcactgttttcctggtcatgagctctccttgaattcctgctgtcaagctgactcagtcgtactgcattaaaaaaatgccactggattcaacttgataatacattatttattgttttgttctttgatagtcatataccaatgatcatttctgattctcattcatgtaccagtgtagtattatatcatattataaataaaatatgaaaaagtattaaaattcctgcctggagcaatacacagtttgctcttagagacagacaccatgagagtcacactgcagcatatcaagagggcaattgaattgctcaggaagtttagggggatgggtaggaaatgactttagaaagatgggtcggatagaaacacactgaagcggagatgttccaggtagagggaagggtgaagggggttacatacactggagaacttaagtgatatactgctctctctctctctctctctggtgtgtgtgtgtgtgtgtgtgtgtgtgtgtgtgtgtgtgtgtaatgggctggagaggtgttaagggagggaattgggagccttgtgggaaaaaagaatcaggattttctctgtagcaatgggcagacattggaaggtattcagaagggggttgaaatatcagttgtgtattgtgagacagggtgtcttgtgtaccagtgtcacagagtcccattagggcgtctcccacagtggtatggctgaattatggggactgaattgaagcgatagtgatatgaatgagatgttaggaaagacgtgatttctgcatatatgggtgctcatataaggcacgggaagtattcattctccgtgcatcagatagagaacacagatattaacacattaataacacagtagagtttgctactgggggtgggagtggttatgtgtaacagaacttgttggagttatctagagtttgaggttaaattgtccagtggggccagctggagtctctaggctccagctggtgtctctagggtgcaactgcattctctagggtccagctggggtctttagagtgggtttggatgtggagacatggatcttggagttgcaacaaggaaaaaggctatgaaatgaatgcacagatggtatgagctctgtgtatctgaggtgggcacattagtaaactgagcatgaatcataagcattggcctcgaaggaacaggaagcccaaagcattaggaagatagcccagtgtgagcacccgactcgccagcaaagcagacgccacaacaggatccttctgcaacacgtttattgggagagcattatactgcataggcaagaagacccgaagcccagaactggtgctgcttatataggcctaggagaggcatgtctcacacccggattggttatgcattctacctcatttgcatgttccttatctgattggttattctctctcagtacctcactgagcctcattatcatacctcatttgcatgtctctcatctgattggttattctctctcagtaccttgcagagcctcattatcatgcctgggccaggcagtgacttggtgaaaaactttactgcatatgtacacattggttgtttacccagacttatgcgtggtggccagtggtagccagcgccaccttgtaatggcgtatgtggcttcccacagcccaggttagaaaagagggagacaaaaagtaggggagagcatatggcatcatggtaaccaaacagtaagaattttcaggatgatggtaagccctgaactttgaaggaatcaagtaggcacagactcaagtgtccatggagttggctactaggaggttatgggaaatcttggcttgaacagtttctggcatcttggagaaaggtagagaatgtcagtgtgtccagtggtggatggagaactgagatatttgcagcatctcaactgcaaggttatgaggggtgccattcctgatggtcttttatgttattaaaatgcaacccaagatcagcagactctggtacaaaaccagccttatttagttgtgaccaggggcaggctacttgggttagggttagggttagggttagggttagggttagggttagggttagggttagggttagagttagcaaaggtcatgtgattgtaagataatgttgaaccaccatcttgtgttcttatactccaaagactttcccggaagacttgaatacagtgaaagccaatctccttgggccctccttccatcctcccctttggctattaatgaccctgacaccaacatggagacagagatacagctctggagaaaacggagtcattcaactctttccccattccttcatctccacatcaatgaatccccccccccccccacatttatccacctgtaggcatctctctccctgggaacagttcaggtgttcagctggcgaaggtggctactccttatagcccagttgccatgaatatggattgggagtctttgtcatagatggaaatccctcctgagagctcctgccccgctccgaggcccgcagggaggagtgcagcagtggcctttggcattctgggctgtggtgaatgaaggagaacagatttccttcaatgactgtgaatgatgcatgccaatctatccagcaccaggaattcaacttatctgctttccaatccggttttatctttctcagacagttttctttgcagttttactttgctgattctgtcgcattgattccagccagacccttctgaaggcggctggaaatagagacgacaccctcctccacttggccacatttcccacactggtagcagctgttagtcagagtggacaaagaaggcagggcgcttgtaaaccttaatataaagggaggacatgctctgaacgttgcagacagactgggaggctctgaactgagcaagcgactgctaggactgtatctgagggtgttgagagtgtcacggactaaattgcgactcttgttattttccttcttcattcctgattgctggtccgtactgttgccgaccatcaagatttggaaagctgttttagctccctacatagcaagcctctcagatctttgaagatcattacaaatatctgctcttcaaaatatagatttttttttaagcttaatgattcttttatttcctctgagtgatgcctgagatttgtaattgcttaatggaagactttcctttttttctaggctaacacagtagctgagggtgttgaggtgtgtgtatggtgtaattctattctttaatcagctgtgatgagcagctacacactcctaagaaacgctgccaatttatgtctaatggctgcctttgaggtatatcgttggccccctcccctgactccatggggtggggtggcttcgtgcagcaatgggagacctcttcggtacctgacaagaggccaaaatgaaaagggcagcggctgagagctgttgggctatttaactgaaaaggttattcagagaataaaccatgaaatttggggacccactaccaatcaccgctgttcaagaaaaataatctactggctcagttgtgtgtttggagcaggtgttgtaagtcccagaggttggtgcgattccagataggtgagtcacggaggtagtgtggtttccagcggagttagcaatgggatcttaggatagttggttgactctgtctctctgcctccctctctcccataccctctctctgcatctccttcctttgctttcttcctctttctcctcttcctcctcctttatctccttttcttccctcctttggtgttgggcatccaatccatgacctctgaacgttgggcagatttctcccatagactgagaacgggagtcagcagtattctcccccaagaccacgaatctctgcaaagctagagagagtctctcgctcgaatcccagaaggatatgcctggtacatcttagatggggttttggttaagccaagagcctgaagctacttagctggctgtcatgccatagagctctggtgagggtgccatagatggataaggtttgcctgcttctttctgtgctgggcatgggaccctgggcctcaaatatgctgagttcacactcttgggctgagcttgtcctcagacctgttgtgcatgttttttgtttttgtttttgttttgttgtattttagggtcttgctatgtagccctgactagtgaccttcctgccactgcttttggttacagaagtgtgcctttatacttgacacctcatttccccccgccccccgcccccatttgctgtctcctctgttgcttgtaaacagaataaacttagacaatcaggagtacagttgattttaagagatcaatttggtaaagagtattttagggaaagtacagcctaacggactgtgaaagggctgcttatcatttatattaagaatatctgtcctattgattaggatttagtaatgacgtgggggagcttttctctctcttggtagttgaggaatgaacatgaggactctaaacattgggatcatcattaaattaaaacctcttctgcccaggactcccccgtcttgattccccttctgtttgcatcttcaaatgtgtagacacatccccactgttaagccaatatttacatatttccaacctgcacatccggggcctggcattaaggctcctgtcacatttaatgctgcagtctggggaaaggacagtgaagctagttgcctgctgggtcatcagggtccatttagttgccttcaactctgtttttctttttttgtcagtagcccaggatgtctctttaaattacctacctcctggggactcttttgctaactcttatttcaaatacatcattctggcttttcatccagatacaactgagggggcctaatattaagagcaaagctgcatttggctttcgtgagcccaaagcatgctgggagcttgaagtagagttgatatcatcccagggcggcaggtgctgggcagatgcccctgtcactcctcatcgttccatggtgtactctgggtgcctataagtacagcacctgcagagcctcccagggacagactcttgctcagtgttctggcctgtgcataagtgactctcctcattcctttggccgattctgcctttagctgccggactctcagttatcctcctttgcccctaaatttattgatgcagttaggtctgaaattcccagggtgctttgtgacagactatatgtgtgtccatgtgtgtagtgtgtgtgcctatgtatacatatttggcatgtgcatatgcattttttatatatgtaagatttgtgtgtcatatgtgacacatgtatgtgacctatgtagtatatatgtgagaggtgtgtatgtgtgtgtgtgtctgtgatatacttggtatggatctgagataagtgtgtgtgtgtgtgaggtgtatgtgagttgtgtgtgattgggtggttgcagtgtatgtggtatgggtgtgggatgtgtgtgtgtaggggtgtatgtgtttgtggtatggatatgggatgtgtggatgcagtatatatgatgtggatatgagataatgtgtgtggtgtgtatagtatggatgtgagtatatgtgagctgtgtgtgtgtgtgcatgtggtatgtgtatgtgtgtgtgcctgtgttttcagagtgctaaatggatcacagaggttgatgactcagtggacatcctgtctcaggtttcagatatcgagagggtgaaggttttattggtggtcaaggcagctaataaagtgagctgtgcagttaagagtgcattcatccgaggatggctgtctcacaggctgagggaggaagccgggggcagctgcaggttagcctgtgacagctttatgagctgtatgtatgtatatatgtatgtatgtatgtatgtatgtatgtatctatgtatgcatgtatgcatgtatgtagccatggcagaaaactcaatacaaaggcctggttttaatatgcctgactgggccttctgcttcctgcatggggcatccatgggggaaggaaaccaagggttgtaggctttgtgtgggagttaatttatctttttatagggtgcttgtagtttccagtgattccagtcataccctgtatggtggttcaggaggaggtggtgggagtttaatggaggcttaggaagctcgcgctggccatgtagaggcccccgggcttccgagttccactgtagtttccacagaatttgtttcggctgatattttgcccactcatgtctcctgacctgcaccagtgcttgtcactagtccatcagtatctggcttttggattgttctgtgcatgcagtagatatccctttgtgcacacagtatatatgaattcctttttgaagttaaattctctaaaaattttgatgaaggaaagggtaaaaacacgacaaatgatttctatcctctgacaggtaatgaagtcgcttctgggtgaggggaagcggccagctggtgatctacagaggtggaggtggtgccctgggcagtagtgctggcctgttgacattgcctcttggtctctgaagagaaagctgcagtggcaggaggtgcccttctctgaggcagagccaggtgtctgagggctggctctctggggttcttgaggagttctttgtcctcatgttcttggttttgcttagtcatccactctcaacgtcattttgccccttggagaggaaagggatgcagggatgcctgaatgcttgcatgcccgctggaggcttgtagaaagcccatgggcctcctggatatcccaaagagcaaacttatcaacactggtcagaaacaggcagggcaaggatggttataccttcaggatgcacagtggaattcgtgagcctggtagctggatccattcatttccttcagttctcagagtgcctgaggggtaggcccttgcctcctcatggctgctctctgcttcacattctttctccctcttcttcagtgtcctttcccatagcagaaaatactggcttcctgcttagaatctctttaatgaggacctgtattccctctgtgagagtgtggtggtttgaataagaatggcccctgtaggctcatatacttgaatgctgtgtcatcagggagtggcaccggttgagaatgactaggaggtgtggccatgatggaggaagtgagccactggggggtgggccttgaggcttcaaaaggccaagccacgcccagagtgactttctcttcctgctgcctccagatcaagaagtagctcttagctactgctccagcatcatgtttgctgtgtactgccatgttccctatgtgttgacgatggactacacctctgaaactgtaatcaagagtccaatgaaatgctttctttcataacagttgccttggtcatggtgtcccttcacagcactagaacaacgactaagacagagagctttgccaccctcttgtcataatctctatgcttctgctgtcatctgagggatggggatgatttcgtttttaatgtgtaacttttggggaaacatgaacactcagcctactgcatccagcagaagtcacctgttgaggttcagaccccttaggccatctcggtgactctagcggcactgtctctgtcctctgcgatgtgataacacacgattgcaccctagatgctggtgaggagtctggaagagcaaggagatgtctcctgcattagaagcttcagactcccataggatctggagtgcagaggaggacagcatagctggctccgagtctctcagtgctgagcatgaagcaggtggggagagttgactcacatgcacttcgttggccgacgctgaatttcctaaggttcccacagattctcaagacatttctggtcccaggtcatgcttttcagcctcagttttgcaatgggaagctgtccctctctgctgcacaggcagatgcgccatccttatactcatgcttcaagaaagaaggggatgagctggggaaataggccagttttagagccgttgacttccatgcgtgaggccataggctcagtccccagcatcacacagattcatgtatagtagcaacagggcaacagttcaggtatagtagctgctctctgtaccccaaactccattcaccagagtctgttcctagcacccaccagattgggaagaactacacagcaccgtgtctttctcaccaacaccaagtctgacatacaacatttatactgtgaaggccaaagaaacacgggcctggtagattcgtggacagaaggacaattgctccacatgcattgaaagaagaaaaatggggttcacacgttggtatgtatttagtggatcatagacttctcaaacctttttttatcttttgtacacagggcagagtcactatgttatgtcaacttgaaccaacactttaggtgtcgggtgtcatataccatcgggcacttgctattttagccactgatgtttcataaccacagggcagtgggctcaggagctgccttagaggttgtggtagagtggaataggtgttgacggtgtagaggagctccttttgtagagagctgccacctacataaaatgaactttatgtctctgtggcatggcaacttggggcagaagtttggatgctgatgtttaatgaatgcctgctatgtgccagaaaaaatgtaataaggagcagctattaatgcctgtgacaaatgaggaaatggaggtgtggggcagtgaaggccttccctgagtgtataaagctggaaagactcagccacgacatcagtttcagaaagcatgcccttgaccagagaagagatgctcctgggaaccgcaactgtagaccatggaagttaacattccggtacatctgagcacgttaggacagatctctcactgctgccctgaggggtagccatttctctgttcctgctggacagatgaggaaactcagcaaagtcagatgccaagaccaagatgtggcaggagacaggacgtgcgctgggtggtccctgcacttctttctgtgtgttcctcacaccctccatccacaacttgctactcttccgacccccatcacagtccttggagaggggcagggggcatttcagatacggagccagggaggcacctgtagaagaatacaagatacaagagcactatgtcttaaaacaaatccgtttaccttctgggaagagcttgatagcttcttcctctgcatctgccctgggatagcctgggccaccagccacagtggcccctacaggactcagttccatgcaagtgttccgtgtgtgcctgtaacagtgtgacaagcttcacgcaggcagcccctatcactgagtaaacacaagcgctggcaaacaaatcagtgtgaaccaagcacattaaatggctccctgaataacagccactaatacattgctataattacattgcacatttcgctgtaaactccaaaaaatgatttattaaactcttgggtccttgacagcaatatgttcgatggcagagtaactttttcgaatttgccagcacattttgtgcgtatgacttttttggagtccgaccaaatgggccttttaaaagctctgattagttaatacaccttatatttacgtagctggttttcaggttaccccactgggaggtggccactcccccacttggttttgcccaacacccctctaagaattatcagggctggatagggagagttgtttggttgttttatttatttatttatttatttatttaggtactagatgaaagaaaaggaggtggggagccaagaaacatttcttccatctaacactattaacacagtgtcgtcacctagagccaccactattgagggctctagactctagagcaatgcattgaattagacctcaagactcctgcctgccctctggattgactcctgccctcctttctctactgaagagcccttctgaacttgtggggtttttattgggttatcgacacatgtgcctttcactggtgcctgacacttctcagttataatattagctatgttcatatggctgtgtgctgaataatgggcaaaaacagcttaaaggaggaaagacagattttggctcccagtttcagtccatcatcacatgagaaagacagggaagatttcctggaggtgagagcatacagaagagatttttcacaaggtgacagacagggatgggagagtaagccagaccagaatcaagaagataaccttcaaagtccactcctagtgacctgtttctatcggctcggttctgcctcctaaaggctccatcatagtacccttcatcatagtacccttcatcatagtacccttcatcatagtacccttcatcatagtaccacaagctagggactgagtgttcacatgagctcccgaggcgggtattcccaattcaaaccatagaaataggagctctgctgtcctgtgacacgtccaaggctctgcccacagatgaagcagcactgtcacgtggctgtccagtccccatgctttccttgcagattctccttcagactgttctcttagactctggctaatggggagtctccttgaggcatctttcccaactcctggctgagacttcccgccagggtataaagctagaacagcgagttgtgaccctgatgtgaaagccttcatattcctttacacctgcagcctccagccccctgtgcattccagcagagaaagaagttaaaggtgatatcacacagggaggcagcagccagaattagtcatgggaaaaatccaagggcagaacttcactttccagagatgctctcgtgaaatgcatatctgcgttgacgctgatgatgccatcaatattgtagccatgtgtccctaggatagggctaaactcagctttatacagacacacactttggatttacctttgtgtagcatatcgtaaagtgcagacccattcccctccagctttgggaaaagatgaaaaaaaaatctttctagcatatgtaagctccttcaaatgcgagtgcaagttagaaacgaggctcttagttaaaacttacctcctttctagatcttgaggttccgtgttcagtcttgcccattctgggggaccgcactgtgagcacggttacggtggattgttccggggagctggtggaatgaacacagagggccagaaccgggactgtggaagaacaagggggaggggagccagggttcctgcttctgcggattcagaaggcagctttccatacagcttgcctgtcaagggactaagatccctgagagccaagtctagattgcagtataaggcaactatatgctgtaactcagtaggaagtactttgctgggaatgcataaagccatgggttttatctcagcacaagaaaagaaggaaggaaggagggagggaaggaaggaaggagggagggaaggaaggaaggagggagggaaggaaggaaggagggagggaaggaaggagggagggaaggagggaggaaaggaaggagggagggaaggaggaagggagggaaggaaggagggaaggaaggagggagggaaggaaggagggagggaaggaaggagggaaggaaggagggagggaaggaaggagggagggaaggagggagggagggaaggaaggagggaaggaaggagggaaggaaggagggagggaaggaaggagggaaggagggagtacaaactacaaaaaaaattagacacaattttgaggggagatgtagagagtcacccatggcagccacagttaaaacaactgagaggccataacctgagttctgagctctcccttatttcattaacgtttattaaaaagctctttatgacagctctctctgtgctgagtcagaagacgggagccatagcttggtaggatggctttgtgtaactcttacatttctctctgagacattggaactcagggttcttccctcttccccgtgagatgctggtgttctttgtctggggaggactggcgtcagggtcctggagctcacacttgaacctggaagtagaaatcacagttgtggaagggaaccatagatgtctggaaaaacatggccttgtggtccaacctaggagttttgcctttctctatatcctggagtttagtgggcattgtgcccttggcagtgagcctggacttgaaaggttgggaagcacggaacgttccaagagctgtggggttgtaccttgtgtcttagatccctccaagccatcaggtaggtttgggagccctctccccccactgggcccttgagaataagggctttcaggacatgggagggctggcacctcctgtggtctggggcttcagtttctgaagaagagatgtggttgatagggtgggctggcaggagagaggtttctgaccttcaaggaattccttctgtgatttttacagttggtttccttctgaaggtaatctgccatgcagcacttaacatctggtactttactgagtgggacttaacatctggtactttactgagtgggacttaacatctggtactttactgagtgggacttaacatctggtactttactgagtgggacttaacatctggtactttactgagtgggacttgccgtcaggctctttacacccagaactcagggtggccgatccctctattttttttttaaagacaactatcttttttgacccctaattccttttcggataaaacttatctcttggtgaatgttgccaaagaatcttagaagtctctttagggaaatagattgcacaactctagacttcggcaggacacaggcttggtgggacagtttcatgtgacagttgcacagggtgcacactggtcaatggctcgaccaaagatgctcgtggcgcagagtgtggtggcttgaacagtgagtctgtgtgagcgagtatcaacacggccttcattcaccccactttacatgaaacaaaggtgggggcagcgccttttggttttgattttactggttcttggggtgtatgtttccttcttgcccctggtgagggatagtggagctggcagtttaggcctgtttctgattagcaaaatgacccttaaataagaccaggggaaaaaaatgccctcctgagcctctggggccctggtttttcccatagaagtttaatggccctaggttctgtgattttagctgagaaaatgaaagactcagaatggggggggggtgagggtgtgtgctggtttttgtttagaggtaggtggaggggttacagggaaccctggcccaggcctgaaggactggtttccctgagtgtgggatgttgtaaaagctgtagaacatgctggtggggaaccactctaggggaacagtacactggttacttctcacctgcttttttccaaaaaaaaaaaaaagaaggagtggtgttacacatgtatctttcagtgttcccagaggctgagacagggggattgttaagttcacgccttgcctgggctacatagcaagatcccgtctcaaaagagagaattagagagagggaaagaagacccaagtccttcattcatgatcaagctgggggaagtctccaacaattctagatccattctggaaatgccaggcaacccacagtggtcctgggtcagggatagaaggagaaacacagagtcccgagtgactggagcttcccttatggttttgtgaccgtgtcttcaaacttgggtgtcttaacactgagttgttcagccttcttcttggtctcgcccatgaacgggttcttggtttacacatttaggcatttgtctgctggtggtatttatgctaactctgcatgttgtttatgtgtgtgtagaccaaaggttatccattagtgttcctcaggtgtttgaaatgttctacctctcttgttgtactactatctactgtcctggaattcattagtctagactggagtgtcagtaagtctgggatcctcctgcctctgcacaggacccccttttccctcagagctgggattacgatcaccacagtcaacgtctttatttttaaatgagctttggggattgaactcaggtgccactcatgcaaagcaagcccttcactgactgagccatctctccagctcagctttcatccttttttaatgatactagcatacagctcttgtgacctgaccctttgtaggcctcctgtcatgtgacattaaacacggtcacattctgtgactgtatccaccatccatcttccccatgtaagactccactccccttaaacagtaatttccttggctcctcctgctcccagcagcactgaaacagtctatagattacgctgaagagaaagacctgagtgagctggctcatggaaccttctgactgtactccactgggtgagctcctaacacattgcatgttccacactgcagatatggaaccaaaggaaacacagactttggtttcaagagtggagagggcaacaggcatgcagatgaaagtccccatctgtgtgacaatgggctacagcacaagtgtgggcaggtaaaatgggggtgcctaaggtagcctcagaaagaccaacgtgaccttcaagggagtggcaggggataaataggtgtctgcctgatgcggtgtggggcatggagcctgacaactgcaagagacaaaggctgtgggccatgagcacctggatataacatgtgtggatcacggtgtctggggacagagacagagagcaggtggcattggggctttgggcctggcccaggacctggcctgcatgtaatgatgaatacatagcagggctcagagctgtcctcgaggccaccactgtcagctgcaagagacaaggggaagggtgatacggttgctggagggggaaggggctatggcaaccacagactgcacttggctcccttgggacttttgtcttcccatgagctattttgaggtctaaaccttgaaggcctgtgttctgaagtcagcacttcgtcactgtgataaaatgcctgagaatatcagcttcatggtggagagctgatttcagcctcaggtctcggaaactgcaggcgatggtttggctggccctgtgggctctagctttggggactgtggtgaggtggcacactgtggtgggagtgtgtggtggagtggcattactctcctcttggtggctataggagggggggaggggagggggagggagagagagagagagagagagagagagagtcccaagtgacctcatttcttcccactgacctgaagcttctaccacctcctaatagcaatgggctgaggatcagttcttcaacacactggccttcaggagccaagctatagctccagctgtgggagaaactcatatttctctctccttggattgaatattcagtgagatatccaaggctgctgacaggaacagctgggggagatgggcactgcagccattttctcaccggcaccctgccaactacctgttagagctctttcctcaacgctgcccgtgctccagccggcacctctgtaaaatgggggaagatatcgtccttcagggctcccgacaaggccgagcgaggcagtctctgctgcaagtctttagctggagttcgtgttcagtgtgtggtggctgtcattgaggtctttagttcctaaactgtgacctttgaggaacgtgatccagggcttgaagaggggatttgcaaccactttttaaactgctcacatctgttcctgcacttcgcaaagctgggttaatttttctgcctgcaagtaggtatgtgttcgtgggcctgtggtcaccatggaaatgacaagagaaaattctggaagaagccgaacctcaggaacagtcacacgcttgcctctggccagagtgggaccgcactgtgctcttattctataccgggggtcagtggggtatggagggctgcggactccatctttccccactccagcctttgaatgatcctgttggtctcagagaggcctgagagcttctgcgagaaatctctctgagccctcagccatttttctgcattaaaatttcttccctttatttctttcacatacaaatttaaatctcccttttcccctttaaatcacttttgtgctgtttaacctctttactctgatcccctgccccctcctgcctccttttgaagcagattttagctaatgggtcacctggatgagattgccctgccctcctcccaccccctctagcttctcaagagcaccagttagctttcaccccagaaggcggctgctcccgttgcttggcagcccctcccctgccctccaccccaccccatcccccacccccacccccaaccccccgcggagagaagggattgggccagactcttttcattcatctgaaaataggttatcgattagcagggctgccagtttactacaggggctcttgacagcctctctccatcacattatggtgcaaattttaaagattgtattacatttgctcaggagaattcaggagtgaaaaatgtagtcaagtgtggggaggggccataagaaaatggactgtttcttccactccattatttcctgggtaaaaagaaatgtgtcttcccccaagtagttctgaagtaatgtttgtgtctgtctgtccatctcccttaactgtgagcaagctagcaataccttgactgtgggtatgtttgcaacaacagagcccttctagtctgttttgtggatgccagagaaagaagggaccctgagggggctgaggaggaaatgttggccactatggactggccgaggttcactggtggggacagaggtgtgtgtaggcctgacactgggcaggtaggaattggaggtcactcttcttttcctggtggctttattgggattcaatcaaagtgttataaaatacaccttcttaagtgagtgattcagtatatttccgtagatttgtggtcgctgctgactctctctcattggtaagctactttgtgttgcttcagacctcactgttcttagtcgatggaagcatgcactgttggtctcctgggtctgattcccttcacttgccgcgctgtttgctgtttccaaggctcagcgtgttgtattttctatcaggatttcatttcttttatcagccagtcatatcatattttgttctctatctactcacctcttgttaggaaggatgctgccctgagcattctgcatgcaaatcttggcgaatccatgggtctttttaccatctggtgggtgggtgcctaccagtgggattgcaggctggcgtggtagttcatgttcaacgtttcgagagacttcccaactgtttgccggagtgtccacaccatttagcatctgctcggtccttacactcagccctttgacaccagtggatgggagggcctcgtagtgtggtggtttgttttttatttctcagatgacagtgaggctgagcatctttctgtatgctaagactattcttgctttctctggaaataaaataaaagtaagacttcaaagccctcgtccaatctaaaactgggttgttttattgttgctgcattgacagtgtcctctcaccgtccacgactcattgctttccagatgaagtttttaaagcaaagaagttttagttttgatagagtccagtgtatcaatttttctttgattactctgactttggcatcacatctaaatacatcattgtttgacatgaatgaggcaaaagaggccatgcaagctgccagctttaccctcttgaatcccagcattatctcattatgagtaaatccagaattaaagaaagaaagatatcatcatctaacccaagaccgggagaatttatctgtctaggagttttgtagtcttggcttcagcgtgtgtgtgtgtgtgtgtgtgtgtgtgtgtgtggggagagagagagagagagagagagagagagagagagagagagagagagagagagaagtgcatgtgttatgtgttgtgagtgtctgtggagaccagaagacaacttccagtgtcattcctatgtgtctgccttttctctccccttctctttctctcccttactgtcctgccttgaactttgccacgtcaattaagttgattgggcattgagcctcagggatcaccctatctccacacctgagatgtacaattctaagtgtaatctgccacggtcagctttgttttacgtgggttctgggaattgaactcagaccctcacattttcgaggcaagcactttactgactgagccatctcagccatttggcttcaaattttaggtccaagatccattctgaggtaagatcatccttttcccccttcttaaaaaaacaacaaaaacaaccaaccaaaccaaccaaaccaaccaaaccaaccaaaccaaccaaaccaaccaaccaaccaaccaaccaaccaaccaaccaactaaccaaccaagccaaatcaaaacaaaccaaacaaaaccaatccacaccacaccacaccaaagcaaaccaaacttgaacctaaacaacccaggctaactcagaattgaaggagacggagttggaatggccagtggacattttctgttctgttctgtagtttttgaaacagcatgcatagtggccatcatacaccatgttagggtgaggactgaaataactaacaggatgtgctgtgaatgggtaagggcctatataacctgcagtgggaggaatgtcatggagctggctctcggacaagaggacaggacactgacacacctcaggagaaaacttggcctttttaccagcatcagagacaaccgagcaaacaagccatcagagagacccggcgggttggcgaaattaagtcatgatgaccaaggcaggctgccaagcgagctgtcagggggcaggcagagagagggatcacagttttgctggtggctgtcatgtagtcatttgagaaagctcccgctctgctttaaagtccactctttctttctgcagactttatttcataccccagaccccatttcctgcgatgggtatagaactttcttaggtccatctttctgaggccctcaagaaataggcataatgcgtgggaggaggtgaggcatgaggctcaattttaccaaaactaacctaacttgtgtaagataaagtcactgggtggaatgacctcagaaagccacccccactctctcttgagacattgatcaccaaagcaaatcaggtggtagcatatcaagaggaacctaagtactttgtgcggtgagtttccatcttggtcccagaacattttgggtgcattgccagggatagctcagctctagagagaactgattgacagaagacagtgggtcttgggttgactttgggtagtggtcttgatgcttgtaccctgacatgcatggcaatatctctatacacaggtacacactgtgcctactggtctctctggagaagtggcttcatgttaactgccatctacctgactctaaagccttgagataaaagcaatttttcatctcttctccataaaaaggagtcaatgtattaataatctgagtttatgcagtaacctaaatgtagagggtctgttcttattacaaaattcaggttgagtatcccttttctaaaatgctgtaacaaagactgtcttagattttagattttgattttagactttgaaatatttgtaacatacacaaacacatgcacatatgaatgatatgaatggaagtggggtccatgttagctttccgttattgtcatacaataattgacacaaccaactttaaagagaaaaaagtttttttcagcttgcagcttccaagctcatgattgagaagtcatgtcaatttgggcccatgctggggcaggtactcacgagaagaccattcacctcatgcttgggataccaaagagagatagcaagagagcacacaatctctttggagggaacacttctggtggcttaaactctctccctaggtctcacttcttacattccattgcccctcagtagctccatgggctagggacccaacctttaccacacagaactttgggtgacggtccaggtctagattcaagcatcccactcatggttaccaaagactcatgttcaccccccagtgtgaccagtctacacccaagacttcccatggtctcagctattccagctcaaaagcccaaatctattctctctgagactcaaggcacagacagctgagttcctgtggaaacagacaatacaaacaataaaaagatgttcagctctaacacacaatgacgtttcccattcaaaaagagaggaacaagaaaatggcaaagtgggagtgtggtgagaccaaaggaagactaaaacctacccagtgaccattaagttccatggctctgttctcagcacccagtgttatgatgtgaagttttaagggcttgggccccacctctgtgaccctgcgagctgcaacctacataaccttgatcttgggcttgctctgctctctgatgtatctttcctgggtatctctcattctccatggtctccactgtggttcttctccattctcatactttgaaatcccagaggaagcctccataacctccactcttcatcccgaaaggcctgcatcacaatgaggatgtcaggatttgctgatggtacaaactgtataggattcagcttggaccatggctgtgagaatcgtagagggcctgggaagaggaacgtagcaaaggattttcagcaggctgccccagggactcttcctctcaatgcaaagcctttgaaatgaagtttgtaatcggtggactgttgttgttgccttagtgaaaagggctgactttttgtttttgttttgaaacaggttctcatgtagctcaggctggccccaaactccctatgtagcccatattgaatgataggctcaggtacttgaatctttggtcctcagttaggaaggatcaggggtgtggtcttgtggtgtgtcgctggacgagggctttgaggtttcaaaagcctacatcattctcagttagctttgcctctctctgctgcatgcttgtggatcagatgtaagctctcaggtacttctccgcaatacgcctgccttcctgcccctatggtccctgccaggatggccacagactcactgaaactgtgagcaagcccccaaacgaaatgccttcgtttataagatgtcctggtcatggtgtttctctacagcaataggacagtaagcaagacacactttgagatgagtccttcaggaattctttatccatatgagatgcaggaaaaccttttctctctggggtacagactgtgataaacactaggacctttcctagctactgtggctgctggtggcttcctcctcttctaagatggttggtggaggtttgctattgatgcagctcatagagatagactgctcagaccactcattccaatacctctctaggtttccagtctgccaaggcagaaccaggagatttcagtttggaatccaagatgttcaaacctatagtttttcagagctgaactttttattgcttccctgagattatgttaattgttcaactcaaaatttattcaacccatgctattaagactccgttgcttgtgtgggtggtagagatactgtctcagacatggttccaggtcctgagactatcaaataaggaaagagggtggacagaatccaaaaatgcacatattgttactaagtgaagctagcacctgacatggggctgtttaatcactctgaaggtttgtcttggtcaggcagcaagcaccgttctctctcttgtcccctccttgaagtggggttggaaatggtaggtgctgaagtaggaatccaggggaggatttaaaacaccagaagagagatatggctggagaagcaaggtgaggtgatgggaggtggagccagtgtagggacaagcaaaatgttccctctgcctctgcctctccctctcctctgcctttccttctgcctctctctttgcctccccctctccctcagcctctccctctcccacgcatctgcatatatgtctgtgtatcatatgagtgcagtcatcccagaggtcagaagaagatgccagatcccctggtgccagggttacagaaggttttgagttgtcatgtaggggctgggaactgagctcaggtcctttgcaagagcaacacatgcacttaaccccctgaactgtgtctccggcctaggaaagacatttcagacatttttgtgttttccaaatcagtgagatgtattgatgcaaattgtcaagctgggagacctgcgcatggctgccatcacaccaagggtgcagctctggggaaaatagcatggtgattgctcaaatggtggtctgtggaatcattgtttgatgtgaattccatgaaagtggagactggaacagacacttgagtaaccatggttacaggcttattcacagtgccaagggtctttctgcaggttgatggagagtgggttgcatgcttacatgcatgcttgcatgaaattattcctcagaaaagggaggaaattcaaatacattataacatagatgacatttttgcaaatgttagacattattcttttttaacttttatgtgtgaagtgtttttgtctacatgtgtgtctgtgtatcacatgtgtgcagtacccacagaggccagaagagggcatcagattccctggaactgtagcagactgtgatctatgatataagtgctgggaattgaacccaggtcttccaaaagagtggtcagtgctcttaaccactgagccatctctacagcccgatggtttggttcttatatatcctttctggaattttctcttattgttttttatttctcttattcttttgagactgtgtctcaagtagcctagaatggacttaaactcagaacttagccaaggataaccttgaatcctcatcatcctgtctctgcctctcaggtgctggcattagacgatgaaccaccacacccagccctttcaagactagtctacttgcaagccatcttctgagaagttagtttttaaaccccgtgtggtgtgacatgagcatcttatactgatgcatttacacattgtgtatattgtcttctagaagtgaggggaggactggagacatgactggtgcacattagctttcggcttctgtaatgaaatactcgtgacaatgagcttacaggaccaacttactttggctcacatttcttcatcactagttgacctggttgctttgggcctgcactaaagcagcacatcatgtcatgaatggtggcagagcagaactaccatggaccaggaagcaaagagggaaaggaagggggcttgggacctatgtattcttttgggaaatacccccagtgacctaaggatctgccactaggtcccatcccctgaagggtctacctgtgccaaaagcatcgtcctagagctaaggctttaatacacagacctctgggcagcatcagtatctgtcctgtgtagcaagggacctgcatctcctcagagcctccttccttctgaggaagagagggcttctgaagagatgtcctcaacccagagttttgaagcctagttaacttattattttgagaaagggtcttatgctaagattcaaggctcacattgaacttgcgaacctcctgcttctgccttctgagtgctggaatagtaggcatgagccaccattcccagctctactttattgacgatgacgatgacgaagatgaaaacaacaaaatcaacaacaactataactactagttctacctcctcttcctcctccttctctttcttagtttatttttgaaacaggatctctttttgtagtcctggctctcttggaactttgtatgtagatcaggctggcctcaaaactcacagagatctgcctgcctctctagttgacttcttaattcccctctgtccccagagcttacagtaaaatacagccatctgtttcaattgcttttgtactaaaacaacttaagctttagttttgaaatcatctttctaaattgtatagctcttgggatatatattatatatacatatatatatatatacatacaaacatatatgtatatataatatatattgtattatatatatccatatatatagcatatattaaaaactcataatgagcattgccatatgctgagcactttgtatgtatgacgttatttgatatagcaagccagtaatggaggtgctgttgttatgtccgttttagagataaagtggaacatggagaagaccaggaaggaggagcaaggacgctccttcacaacccacgtctattagttacttccttgttgtaatcaaacacttgatgagaagcaacttaaggagggagaaattactgtggctcctagctggctgtgtagccatcgtggtggcagtggcaggaggcaggcatttggtcaccatgcatccattgtcaggagaagcagagagagatgaatgttggtgcccagcttgctttcttcttctgatttagtctaggacttattgctgccctcatgtagggtaggactaatcatttcagttagtgtactcaggcattcctcataggcgcgcctggaggctcatctcccaggaggtctcagagcctgccagtattaaccatagcgctgaggaacccagctcgagtctctctcctactgaacctgttcaccatggtttgcttggaaagaaacaacacaagcacagactaaggaaaaatccggtgcatcaatacagatcagagattcaggactgagaccccgctgagtccactgatgatgcttcaaggagctaaactgtatggtgctaggaaataaaatctgtacttgaaattttctctttactttcaattcaagatccataattgattattcttgtttttttgttttgtttttttttgtttgtttgtttgttttgcgatagagccttgctctgtagccctagccttgaacttgctgctgtgaagctggcccccaattacaggaattccatcgctgcctcctgcgagctactgggatcctcctaaagccctgctctccccgtccagttgagtctgtatttagaggccagttcctcttcacattgataaacacatttttcagattttcccttgtttggaagtggcttgtgagtttcctttcatcttgtttgatgcaggagggtgatgggtagccctgggactatagcaatgcccaagacttagtactgggacacaaagggctgcttttcacactttagaatctgatatttagttttagaatctgatatttagaatctgataatagtgttaacaagatctgacagattcaaatggcaacattggctctggtttctggagagatggcaaaagaaagatgcctgggatcaagtattggtgtattatgaaggccttcaaagggcatttatagcagtttcctcattctgtgggttccctgtgtgtgtgtgtgtgtgtgtgtgtgtgtgtgtgtgtgtgtgtgtgtgtgtgtgtgtctgtataggcatgtagattttaagagttgtttgaccaaagttattatatggtacaaatatagtatataagactccggaggtgtttagtgtatggagattgtaaagggtcttattttgtaaaggcaactaacgacacaggaggccttagtaatggctgttgttttttatgggctctgctaggattttatgtaggaatcagtggtcctgtggtgactgaagtggttttctttagaaagcaaccagggcgtgcttagatggtttttcttgaaatggtacactaccctcctcctgttccaggcagatcatcttttgttgtatatggaaactatagcatgctttctaacactctagtctgctctgtaacatggtagcctgctctgaaacactgtagcctttgctgtaatactgtagcccactctggaatagtgtagtttgctttataacactgtagcctttgctgtaacactgtagcctactctgtgcccagccattgcttcttgctttgcactgaacactctccatgccttattcttctccatcattagtggtccctcttcctcccctggctacccacccttttaggtgtgattgttattcctgcaatggtggctctgtatacccacctagcctggtggccacatccctgccattctttcatcaaagtctatcttaatgttccttctatttaagaaaaacaacctagaggggctagggataaatctcagttgacagaatgcttgctgtgcacgcacttggttccagccctggcactatataattcaggtgtggtactgaatgccataatcccaggatttcagaggtaaagcctggaggattagaaattctagttcatattcagctacatagagagcttgaggccagcctggctatgtgagatttttgtctccaaaaatagctggccagaaggtagccctgcatgttttcccttaggctctgtcccctgtattttgagagagggtttcctggcctgaaactcaacagctaggccaggctccctgtttaggctcccactcccccgaccccaagcctgtctatgctttttctttttcatatctgcatatgtttaatatgtgtgcatgtatgtgtatatgtgcatttgtatgtgagtgcatgtatgtgaatggtgtgtgtgtggggggggttaggcctgacatactagaagtatctagtatgtcatactagaagtcttctttagacaatcttgtactttatactctgaggcagagccattcagtccaaccagagcttgctaatacatcaagcctcctgagatggctttactttgggaatcccttgtctcctctactttctgaggctagaattataggcaggctaccatggccccgggcatttacatgggttcttgtggatctgaactctggttctcttgcttgtgtggtaagtgttttaatcatagagtcatctcctagtcttctccctcctcctttaaaaatgtgtgttctggggattaaacacatgttcttgtgcttacatggtaactacttgaccaacatggctcttttcccagctccaaggagtcttttcatgagaattcattctcagtactcaatttagagatgtataaaggaagggaacagaactcagtggaagaagggctgacttagcagtcacagctctctgcgtctgagtcaaacactgaaaagagaaagaaaagtgtgtctctatgactgagtaattaatacactctcagagtaaacaggtgaggtcaaggccaaagggaaagtactgctggggaagtatatttatataagttaaagggatatatgggaatattttgacattttaatctccccaaagtaaatgcacagcatgggaggtgacaagtatacagggtaccagtgagcggatttctggtgacctcagagcacttagcacacccacgtagacttgaatttcacacatgacttgatatgtgtgcagttcccagcctacccccccccccccccgcaccttcctaactgcatggctttagtcaatccacagggcagaagaggccatggaatgaggctatggaggggtggggtgcggcttaggagttgagtgttttcctagcatgcacaagaccctgggggccatccccagtaccgagagagaacagaacaaagaaaacaaaatgaaacaaacaaacaaacaccctacagagttctggccctcattcctctttcctccctctattagctgtggcttccaggctactttgctcagtaccgaggctgtgatacagtggtgagcagagcagccccaatacctgacttctggtggaatcctgagactttagccagtgtgatctgcagccagggcccgagttcacatctgagttcagccactcactaagctgtgaggccttgcaaaaggtacctgtgtctcagagcctcagttttctccctataaaacaggaatgatcaaaatctttacctcagcggctattgtaggatttaaaataaatgattcatgcagggtgattaaaacaagcctgatattcacttagtaagtccacaataatattagtcatttataactagggtggggacagacattaaataaattataaataaacatgggaactgtcattaaacaaatcccagatcagcatgaagtcacacactgcagtgagttgtctaagggaagggtaaaggatgtggtgagtgggtaaaataggagcttctgatatagacagggagactgagtgggcagctggtggtgcaaagagacctcgccacagtccggggtggagatggggagtgtgtgagcccacctgaggctggagtcccaagaaggctagcagaacccaagggcgtttaagcatgtttggctcattttaaagatgaggtacagaaagatttcatggggtgatgaggttgttggtgaggctggtgaccaggcaatggcaggagctcatctgtgctgtttcagcagcagaaggaaatgttttacgcacaagcttcccttcacttctgtccccctctccccaccatgtcctctccttcctcccttctctcatttgtcctttcctggtaggttctcactatgtagtccaggctggcctccaactcataatcatcccacttttggcttctctagtaccgagattgcaggcatgcagattactgcctgcccatattttaatcttaaactcccgtcaattcgagtttcccttggatgccgtttatatgtcttttcactcaatgagtgaaggcagagtggcaagccgtcttcacgcggagagggcaaagcactagtgcacacgctgtgctcccaccacacgcatgcatatggtggttccctcctgcagggtgatgagaactcagaggcatttattaggtggtaggaagtgcagaataggggagaattcatgttcccttttgtttatagattaagataattggaaccatgtgttttttttttggtctatttgtctactcatgcatcatacgccagcatatccatccatttacctagccatcaacccatctgttaattcatctaatattcatccatctgtccatccatccatttgatttgtccatccatccatccatccatccatccatctgtccatccatccatccatccatccatccacccatctatccatccatccacacatttatccatccatctatccatccactatctacttaccctcttacccatccatccatctcccaattccatctatccatctatccccatccccacccatctactcatccacccatccattccacacattcacttaaacacttattcattcatgatttatgcaacgcaaaagtgtttcctaaggagcacaatgagccaggcattttcaccaggtcttcttcatgggcagccagtcaaataaacctagcccatgccctcatgcaggttgtggtctgttggtctgtcagtgataaatcaataggaatttatgtgtctgcacttgatatatgatgttaatgtgttatgggattagagaaaagcccacaaggaatgtgcggtgatgttgatcccagaagactgtttctttactagcttatttatttttaatttccaagatggggcctacaatattcccacatctcatttctctcctaaatctcattctcgcagatgctcacggaaggacagggaagctatggctgccgcacgttgcattcagtgaggagctgggttttagagaccgtgttttatttcctctttggtctcttgagtctggttgatcttgtctagagccctgataatctcctagacaaaatatttaaatcttctgcagctcgagcggctttgaggcaggaatattgtggctgaaatcctaaatattttggaatatcattaatgggagggttacacagcagatgtggttcgcaggctccatccccagagaatgttagaatctttgtgttgggaagtgtacgtgaatagtcatcagattctccagcctcctaattctgtaatttttttgtcctttgaggctgactcccactttcctccatctgcctctggttatcctcattttttttttttttggtctttgttttcagaaaaggataaaaaagtgtttgcactaaaggagggacagaggatggcattgttactaggactgttgctgttatgttttctgggcagggggcactgactgccttttcccagagactaaagcttcatgtctaagaagccattcttgtaactgttgaatttcagatgtaggctgattagggagtcaagggtttccccaaacgctctccatcataatgtatagaaacaggtataattgtagcttcatgatgagcttcagtgctgggtgtttttcagaagagctgaaggctcttgtgtgacctgccagttgttcctttttcttgttttgtgtaaaaggcaaaaggacttttttctgtcctgggcatcattagcgaccctgagagggagagtttgtttctttcattctgctgtgtgtgacagaagccggggactttctcctggccacacagctgggagctgaagctggtgtgagctctgcctcaaggctctagctctcccgtgtgggtgaggaaccattcagtgtcaacattgcctctcccctcttgcttctgaaccactgcaaggtaaacttgccaataggctgagttggttccattttgaatttagctaacagttattattgtgtggatctgtgtgtgcatgaagggtacacgtgagtgcacatgtgtgtcacacgtgtagaggtcagggaacaattttgtggagtcaacaattttgaaggagtctttcctttcacctttatctaggttgtggggttctcttattgttgttgttgtctttgttgtatacttaggtagacagcctccttcagcaagcacctttacctgctgagccatcttccattttgtgtgtgtgtgtgtacgtatgtgtgtgtacgtatgtgtgtgtgtatgtgtccttgtgtctgtgtgtgtctctgtgtctctgtgtgtgtatgtgtgtgtatctctgtgtgtgtatgtgtgtgtctgtgtgtctctgtgtgtgtgtgtgcgcatgctgagtgccttcctggggtactggtgatactcccagatccaggaagatgtggtgaggagtctaaagtctctgtatttccacattcaccacatttgcttcctgacctacagcctgcacaacttctgtgccctctgcagctctgcattcagaaaggctatcagccacctggataattgctcctttataactgcagacaaccggggagtggataacgacaataaatggcttgtaattctaggtcttagatctttgctgtaacataaagtctgctctccagttccttgtgttcacaacctggagaagtcaaagctaaccgttagagaagtcattgcccaccattcatgccctgccctcagatgggaacaagcttccctttttggggcctggaggtgggggtggggcaagggagacatttctaattttgccatgcttctgtaggaatttttttaaatgggggtatgttttcacccccagctattcctcaccacaggagtctgattgtatctgaggaggtggcccaagcttcagggtcttttatttcctgttggggttttaaagttacccttgtttagtttgattccattttataagtcagcctgaatgttggaaggcaggcggcctgttagtccatgttatggctttggggcataagaatcacagggcagctttctttgcaattgccaggcagacatatgtcctcaattatcccatttggaaggactaggctctttgtaccacccctcccccaaggtctcccgctgtcatgaccaggatcggaaagatctgggaatatgggggtaggaaagttaaaatgtatgtgccaggccctttataacactggcctctgtccttactcctgcttgggtatcctcagaatcaactaagctgtttctgggaaaagatcacaaaattcatctaccctggaggacacaggccaaagggttagtggagagaccatggacataagagatggacagacctaaggtcttttttctggtctagttgtttcaacttgggaaaggtcacttaattatcctgtccaaaatccatcctctctgtctgtaatcttggggatggtacctaggatttaatgcacacctggcaagtgctctactatttttatttatttatttcgggttttttttcccttatttatttttgagacagggtcttatgtagcccaggctggcctcaatagttatgaagcttacacctgcttacaccttacacctgctgcctgcacctcttaagtactggacttacaggcctggctttttattttattttgagacaaagtcccattaagttgctcaggctgcccttgaatttgtgatccttctgcctccgcctctggaaaacagctggcgatttgttaaattttctgactcccaatctctccatttggaaatgaagtgaagctgtaaggaaactgattttggctccataagagactggacatatggacagtttttgtataggggcttccctgagtgacttctgagtctcaggcatttaataacgatacctatttccccccttgcctctttctgtgtggattttcacccagacaccttgccagtcatgtttcaagacgaacagcgtggctcttctttcagcctgggctcccaaccctgtagattttaccttggcagatagattactgcatctagaggttgcacgtaggtaatactatatggatctctggagttaccacggagtcagcatttgtccctgcttaactttatattgagccaagaagcgaatcatttcattctctcatcatggggttttatggtattgctctggctggccctgggcttccaggtgtaaggcattcttttatctcagcttccatgtggttcattttggtttatggtttcacccaaacttgcctgacctcgttggttttggtcttttgtgaggtagcgccaaccagagtgtgggaagagagacccgatcaccttctggaattcaggaaacaaaggaagacaagagagagagagtgcctcactcaagctagtttcctcctgaagatttccccatttctctataggctggggacaaacctctggagcttcggggcagtctgggtccaaactatgagcattcctctcccagctcagagaggcacatctccattgcatggagcaaattgcatctcagctgacaactttcctctaagtttaaactggttcagaagttctggaaagtccttgttcaaattctcctctgaagctgtaaggcagattcaaatatgagccctgggagaaaagtcaaaagagcaaatccatgcttctaaaatacagaagcaggggacacacatgctgcttgaagcccctctaccactggtctgaagctatagtgaaatacacctatgttttaaggttctggaaaaatccctttatagctccatgtgagtctcaaaacaaataggtctcttaaaggactcagggtttagccccccccccccaaccaccacaaactgcatcctttgtgccatttcttaactgctcatttacgagccctgattggagccataaaagagcatctgtgtgttttcagcatccttgtgctacctcccagcaacgcctccttcacgcactgcagtttgtgcacaccagggtaccagatactattaaaagcaccattactatgttttattgttgttggtaggtgcagtttcttcccagcgtttgctggaataacttctggaatttgtggtagcatcatcattaaggtgtgtggaaagtaaacagactcttgttcttcaggaaaatttgaccagggtagagaaatgccgccgccatgttggctcttctcatgagaatccaggaaaactccaggaaatgcacactgacaatcaaaacttgtagtactgatgaccatagggatgcggtgagggtgacatttccacagtaatgacggagttgtcacattcccctgagagagcaaaacagcttggtgagtgccaccatgtctccccgggactcccctctgagattggttcagagcagacaacagcaaatccttcccagggaagttgttctgcttggtgaattttgctgtgttcagagaccaggcaaggcaccctgacttttcctctgtggattcatgccgtagggaccctcacatcagctcatatgtggtgctttaaaatacaccccaagtcccaataaaggctgaaagcataactcagacaaaagtcttacactcctgtaggaaacaatgaggcagctggttagagatcagaaatgggacttgatgcttggagccctcctggtgcctgctcccagaatggcactcatttccatctccccggtccatcatctttcttcaaaggacgatgtgtttgtgtgaggtgtccctgagctgattttcccggaggtctggaaagggagcgggactccacaattgatgaagtcaagtcatgtgtctgctccatgctgtgattcgtttctcgactttgaaagaacaaccgcaggcttcagagtagcccgaggcacatttgtacaaagccacgtgggcagtttttggtctggagcaccaacctcaatggctgctttgaggcatacagtgcaatgctgttggaggagaccaggggagcactactgcacacagtagcccggtgtggccctcacgtcactgtgagctgcagatgtgtgcctcaggtcaggctgcagattcccacgaaccctccaaccgacctcagggttctttatgctttgccctttaagaaaatcaaatatgtgtttaaataaagacttttaaagactaaagaactcagagactgtggcaactccttagcaggtttctttcccctcctgttaaattcctcacagccactttgatgtggctgatgtggctaacaattgccactggacggattctaagagactggtttcaaagctgactgacagattaagtagcagctaccacaacagaaagtggttgtctgagtaaactttagctgttttcccagtcgcatttggattgtccatatagaaagttttcttgatatttgctaccaacacataccttttatctccctctaattatcaagaacttagtgtgtaacaggaaatttcaataccaaagtttttcctctttgtaagtaatatgtgccatggtagagacaggaaaacataagaaactaagaatgtgaaaatctcctttcacaccaccgtagacatgaagtgggatttggagtttagatgaccccaataggctggagtgttgaaagcctgatttagaatggtggagcatggtgtgcattgtcagcatcagtccgagctctcagaggacgcctgtaacacccaagccgaggaggatcctcagtgtagacagggtagtgttaatgaataatgactgatgaaggactgacggactgactgactgactgactgactgaatggttgactgaaggactgaatgtgaatgactgaatgagtgaatgactggatgactgactgaatgactgactgaagaactgactgaccgaatgaatgaatggttgactgaaggactgaatgtgaatgactgactgaatgaatgaatggctgaaggactgactaaagaaatgactgaatgaatgaatggtgcaaataggaaaggttttgtggacttgaggcaggacctttctgagaaaacttggtggaatacatccttcagtttcttactagaatattgagacactgttgggtttactgaaatatgtgaagtgagtgggagctacagcagaacagagtgtcagaggagagagcagcccttctgtttgctttgtggcttcaagatcaatgaggagcccatgtggaagtgatctgtgcggccatgctctcccctggacagtcactcgctggtttcaggtttttttggcaggctctttttcccagtagattattttctattagctaatcaagggcttctggtctcacaatctcagcctcctctcctactctcccccatgtgccagggaatttttcttggcatttaaaaccaaaactatagactggctgtgggaattctacttggctgggggtaaaataaccaatgattgcacataattgcagaaaacaattttgaatgttattaatgaggtgttctaaacaacatcttttagccctttgtctcacttagcagctgattcacccaaggttcagtgtactgggattcacagtcatctcccccaatgacagctccgggcccttgggctttcataatcaacacagctggtcattttcagggggtatttccaaggctataaagtaagcaggcttgctggagagccacacaccttcagctccatccatgactggctgtctttatgtggcgtttcctttccttccacaggcatgggaagtcctgaggttagagatgctaagggcaggtccctgttggctgtgaatatctccgttgcctttcatttccttcctatcacccaggcctcagcatctctacagcaggtcaagttgtaaggtgcggagcagggctcgtggggagactgatggagtgactgtaggatgctgtctttcagtgtaacctgagaacagggcatgtgtaggtcagtactgtggaccatggagaccgaagctagcccactttctatttcctagaatgtctgcagctacccagagtggctgcctgcctagtaattatttgttgtctgtcccactgtctgtctgtcaggcactaactgctctataggcattgtctggatgccactgttatttatttgactatcagagtgtaagccccttggggtcaaggaccttattgtcctggctcagtccttgtatctcctgtgcagcctagaatatactagacacttaagaaatgttaacaagcagattgatagggaagttgcttaacagcttgcaggtgttgtgataaaatacttgagactccaactttaaaagagggaaggtttacttgggcccctagttttggaagtttcattctctgcatcttgatctgtggcttaggacccatggagagtaattgctcacaccgtgatacctgagaaataaagcaaagagaaggggtagatttgacacgggtctgaaaggggcttgtatcgagtgagctaacctcttccactaggcttcacctcttttttcttttgtcttttttacaaaccccatttttggaaacagtgtctcgtgcgtgctagctttgccttgcacttgctgtatgaccttcctgttgggaactcgggctgaggaatgcactcaggacacaggggcctttgcatcagagaggagagtgcagagacaggcaggactgggaggggaagagaaagtgatgagagcactggtgggtcacagagagagttgggaggctcaggtagagcaggtgaccccttcacccagctggaaccaggaggccctcatggagaaactcgctggaaagctgtcaagattctgacaggaggagaggagagaggtggagcactccaggggtgagcttcaattgtattcttatgagggacattgaaagaaacctgtagtttgaggggagaatgtggcataggccaggggttgtatatgtaaaagtaaccttcatttgccagatgtcattgttggctctgagacttcctgctgaataccctcaccttttccagttcttactgaactctgggtggttggttgaactcagctgttctggctcaaactcctttccaagctgactgtttcaaactagcttctctcagcttctcactgaattgctgtgtttggccttaaagtaactctggcagtctgttctaatcttctgacttgttctcattctctggctccttctgtcacctgcaaccttctctggaaaactgtcctggtaaaactgcctccctccccctccctactctcttaagttgcccctctttcctggactgttctcatgagagttgggcatatcttatctctgattcatcactttgtctctcaagtagatgtcactttcaaacatggctgcttccttctacaaactaacttcaccttcattgtttggggttaaaggtgtgtactaaaggtatatctgtgttccagtcagaaggattaaaggtgtgtcagtccagctggatcacacagacctagaaggtctttggatgtgatcccttttcagagcagccatgttgctggattaaaattcctcacaggcttggttagaggaggagagagcacaggctagaagcagacatgggatcaagcatgtgctttgtcacctggcagtgaggaggcattaaaggttgatggatgccaggtcctgtgacggttcccatggtgatgttggctaggcatcagtgaagatgggccggtgtgtgtcttacagtgatattagctcaagtgtggggtcatagggaacagaaaaaagaaggtgacagagagacttctattccatgtggtccttaagcagcattcaggataacctggatgccacaggaaggaagacagtcccttccaatggtcagagggttctttggtttcttccaaaggaaaatctatttttctctagggtttcaccttctccctcagtagaattcagtgtgatttcattgtatctgagagggcagtgctaagggttctctcaaagcaaaaactggtggaaagtgagttttcagagccaggcagggtggccatactctaagctcagcgtttgggaaacagaagaaacaggagtttaaggtcattttggccctttggcaacctgagcttcacgacgcactgtcttaaataaccaaggggcagatgggttatcccaagatgagggattggctctctgagtctggagtctcagtgttccttgatggaagagttcatccagttgctagcacaagggcagccaatgttcggagtcctccctttagcacctggctctgtgtggaacatccagggatctgtggtttgagtgtgcctcctcaaaactttcatgttggaaatggaacccacaaattcctatcttgaaggtattcagagttagggacattggggtcacatgagttcattatgatgtgactttagaagagctcagacctagtgtgtgggctctgtctcactacgtgatgccttccctaggttaccagaatgccagcttccagagctgtgactcagaaaccttctgttctttataaatcacacagtttcaggtacttggttatagccacagaaaatggactatagccgaggcttctacgtgcttttcttcccctaagggagctagtcatagtaaaccattcgctgacacatttgcccttcccttctttccacaaaagaatgttcttttcttcttgggacaccacagtcatgttactttttccagtccagaaatacatcccaaggaagcacagcagcttttctgctcacaccaagggaatgtctgagtgggtttcgtgtctgcaagtgtgtgtcccaggggtgagtctgaagagaaagcctcaccaactgttgctaagtggagtattcccttgtgaatagagctcactttacagccaaaccagactctgccttgtctgggcgtggacttgagcctttgccagaggatccccagacatcttcccaagctcctgtgtggcccaaggtgcttgatcccagtgagtcagagcagaaagctgctcgatgatgcacaccagatatctgccaccaagagaatggagttgtccttgtcaccaccacagctgtccaatttcctagacaatttttttttggtgtctgtacgcatgtctgcatgtggatgtgcatacatgagtgtgtacgtgtgcatatggaggcagaggtcaaagccaagtgccttcctctatcactctctacattattgtttgagacaggatcattcactgaacccagagctcattgatttgaggtggctggccatcaaaggaactccagagatctggctgcctctacccaggccttggtcctctcctgcgtgctgggaaatctaaactcagttcttcacgcttgcggaacagggagtttattgaacgagccgcctttctagccctgcagcttccacagcttcccacacggtcctgctttgaaaactcaagacagctgaaggtgcttggtcatggcaggctggtcacccgaggtgccttcagatccagggtcactccaagttaggctcctggctgggacgcttcctggtgcacccacccacagatgctgctctgggccttgtttcctgacaaatcctccagatgtggtgctactatgtatgcagttcttccacatatccctcatgccccccctcccccattacccaaagacccagaataaagaaattaaatcttctctggcctttgtcttctcctactatagtcatacaaagaaagacttcctggcagggccatttggttccttcttgggaatattcctgtcccctcccaattattgagaaaaacaagtgaactcgttgacaccacactaagttaatcgtgtaggtgtccacttggcatgcacccacagaagtgggctgggttggggaggctgaagggctgggctaataaggagctattgcctctagcacagtgctctgggcctgcagcagggctctttagccatacctatgtgatgcttaatattgactgtcagctggacaggtcttagaatcacttagcagatgagcttctgtgaggaatgctctagattaggctaattgagatgaaaaggcctaccctaaacatgggtgtactgttccgtgtgttccagtttcctactgacttaaaaataaagtgagctgaacacaagcattcacttctgcttcttgacagccatggcttgcctgctgtgaaggtcatatgtacccttgaactgtgagctggcataaactatatacccatatatacccttgaacagtgaaccagcataaatgctcccttacttaagctttattttataattgtgtgtatgtatgtaggcctgtgtgtgcatatgtgcacgtcagtgccaaggcccttggaattcagaagagggagtctgatccctatctctgtagttataagtagttgtgcactgctctgtggggatgctgggaactgaacttgggtcctctgtatgagcggtgtgtattattaaccactaagctgtctctccagtctctgctttaagttatttatttattaattaagtgttttagcaatgagaaaagaacccaccattcccaggacagcttgcctgcgatgctctaggcaactgggagacagggctggcctccacttccctgcctagcgattctacagttccccttttagaaacagccccatgctctcgcacagagaagtactttctttagcctcatttttgcagtataggggttagacacaggctttataaatggctttgctcctgagctatactgctgaccctgttcatctccactgttaactttagggcctggggatccagaaatttgctggtggccaaagaaagtcatggaaactggggccagatgttcctcctcttgcaggatacttactacctcccaggtcagctgccacttgggatgggtgcaagatctcttccccactccccgctctttttcaacatcctcatatagacagatattgtgctaattgaattctgagtaagatgcaactgtgaacttccctgcctccttctcctcctcctcacacacagcctggcctcaaagcttgtagagagagtcagtcttctgtttccatccaccctggtgcagggtggaagtctccctcagcttatgtgaatcctacccctttccccttagactcagagccaacacgtgtacgctgatgtggctctttgtggcattgccatgagaggagggcatgctgtggtggcaggggagtctgttgtgtgcccaccctcctctgccctgctcctgtccgtcacaggccacactttagagcaacagcatccacttgttgggcatttaatacccatggatcgaataaaattgttttgtagctagaattttccatgactgtaattaccaaaagattctagttgttgctcgtgggtgtcctccctggagctgccacggaatgagaagctgacctaattcctctgtagttcaacttaataagcagccttaacccatttttaggtctattgactgataccctttgggtgagtgtggctttccatggtgggtgtagagatcagatgtagtagggtgtttgtccccccaccctgttaaactcactcatttttcggttcacagcaatttaggtcaattccagcttttaaagaatgaacctctgtaggaagaggaaattaaccagaccttaagggggcctggttaccataattggccccctgagaacaactctcaggctgataaagctgggacaggaccccatgactacttcaggccatcacctcacatggagagcgctgtggcttttcctgcttcctgacaagtatggtggccggcagtgactggggatgtgcttctgggtgtgtgagcacttggctggcacgtgagaaaccctggaaaaaataataaaaaagatgtgtgttacaaccctgacagtcttcctgtttcttctgttctttttgtgtctcccccgccagaatagactgcatcctctttcttcttgggaagagggctagcgaactttagtcctccacaggacacaggtgtagggcataactcaactgaggattgaggactttagacgggaagactcatggcaaaggcagggcacggggacgaaggtgtggtcaggctatcattctatcgaccctgaatataaggggcacaagtggcccttgagtcacagacatttttaccatcatcaagaagcctttctgaagtgtggatatgaatgcgggccttgtgttctgacctgtcttctcagtttcctgtcctactgcaagcagccttatgttcccccagcacagtcaccatcctccatgaacctccctgtgcattccctgtccttagggactgtaccctctcagagtgtgagccaaaacagatcccccctcccttgtttttgttacatgttctatgacagcaaaaacaaaagcaacgaatccactgcccctttccacgacatttcatttctgaagggaccagtagccaagagtggatcagggaaacctgttccttgcagaagatggacagacatatagctgacacatgggggctcactgagctcagaggtcattccaaacttctctcatctccgaggccagctctttgatattggtgtatggggcaatttaatatgtttttacatgaaaacaattaacattttaattggttttgttttgccatgcccctttctttggctctgtcttacctccatgttctgtttgtcactccatcctccttttattcctttcttaaatgtacaatatagagctttaacttagttttccagaactttccagactccttcaacatttgcaatagactttaacattacttctatgctgaaatttgatttaagtgaacaactactttctaaatggcaattgtgtcctttcaccagactaggtcattagacttgagatgagtgctaagtagtgatatggatgattccctgggaagcacaggtcttctgggaggatggggaggagagccaggtgtaaaactctgctaggaggaaggatgtggtcttcctcaggtcctcatgcttgagcggcaagaactttactgataggcccatctcccttgccgctggaatcttttccttatggccatttctttaggtttctcttcttccccagactcatattttcacctttatcacaagaatccacacacatgagaaaacaaagtaggtacctacagtttgagactgcttatgtgtgataatcagttttttcttactgtaacaaatgcccgaggaaatcaactttctaagaagacaagttaatataggctcactgttttggaggtttcagaccatgtcaaccatggttgacgggctttgttgacacacatcaaggctgtctgtcacagacgtgtgtagctgggaagatctggccacctcttggcagttgtgaaataaagagaagatgagaaagagcatccccgtatctccttcaaggtcacacttcagtgattagcttcctcccactgggtcccacctcctagagctctcaccacactcccaagaacatggtgggtagttgagtacattaaagacccgcagaggaactttaggattgtgacctcagaggtccagtggtgtcttgcttgactttttcccaaagagatagagcaagcagggtgcttggagttcatgttgtaatttgaaaactgaaaatgtgccctgtacttttcctttagaaagacaggattttggcttgaattgatctcccaagatttcccatgaaaggagaccagccccaacctcataatgacatcacccatttctccttctttgtctccccctctttgcagtgttgagaatgggactcagcatctttctcatactaggcaagtgcccctcccccccaactcacaccccagcccctgaactatgatttcattggaatgactgaaccaaaaagaaaaaagaaaaagaaaagagttgcaaatcactccatactgtgtcaacatttcctgaagacaaatagctctgttttttaaggacgctcaagagcagatggatgtgtgctggttagaagaagtctccctcctatgttcctgaacaaggtctccacactacccccactatctccttagtggtccccgggaacaaaaggcaattcagatcacagaatattacttctctcgccacagcatcacactattaaaaataaaactgtccctcaaggcaaaacatttcatttattttcctttgaatgactaacttgtttattaagatgaaccaagtggctacatctagatggagcacaggcaagaaaaattgatttatcgtaggcttttggaaagcaggctttgtgttctctggaattatctttggattttaaatgaagaagagccatttttgttttgttttgttccccaaaattggtgtggctgggctctctctcggatgactatgcctcaggtagttcggtcttgagtagtgtcccatgtgaccttgcgtcctgtggcagagcatcccctgagctgtagcaaggtgtccctttgaggcagactaccttccttcttctgctgcagtctttactgtttaataggcaaacatcccccttttgtctcatttcatgcttgagaccctgtcagactgcatctgtgttcccttcaggtttccacaaccacctttgtgttttccaggcccagtcctgaaggagctcacagggagggtactgtgtcactagggaactttctattgctgccctttcctctggagacataggatgtgtctacaggctctcctgatcaaagctctgttctaacgtggtaaagcttgaaagaagagaaagatgtaaacaattggaacaccaagagaccccacccattctgataaaccccacccattccaataaactctacccactctgataaactccacccactctagaataatatggataccttgtaatttccttatagaagctagatgccaaatgacacctgccttcctttaggtggtgagttctatttggcgttacacacacacacacacacacacacacacacacacacacgcgcgcgcacacaccacattatttctgtctttgggttgttgtctgttaaagataattaacctcattttttagatgaggaaattaaagcttgctcaaggacatggattgagcagtaatgacagccaatgctatcagccagttacacactctcctgtttggtcatttccaccctgttggtttggttttaacgtccccccaattttataatgtgagctaggagaaaagggtccataggtggcacatcatcttttctgttagacagagtctcattttgcacaggctggatagtgttaggaacgcaggcatgcaccatcattcctggtgtgtggtgctggggcttgaacccaggactgggcatgctgggccagcactctcttaaccgagctgcagccctagccccagtgcaccatcatacttaacaaatcccaatatagtgaggtgataggtggccacttttctttatcccttattcacgatgcctctgaagagggctcaccctagttctgctcatgaagacctttttgtagcaggcagaaggcagaggtcctggtagaagacacagttcctgaaggctgggatttccaggggtggccatctggttttctctctattggctcatgccctatgagcaataagatccagatccctggggggacagatcaggcctgtggcttcttactggagcgagttaagattgcctccccattgtggttctaccccctgggtctagtttgcacaggatgagcaggcgtagcatcaggagctatctccccaaaggaagaggatggaattcaggtgaagacccgagggactctatctgttattcctccttggtcccctctccccatctaaggcacaaaagaacagataggaggaaggggctcattggaggctcagtgatggggtctgatggtgttttgttccatcttttaatcacctctggcagaaaagcatcaagtgttccctcatcccctgaccgtccaagccagcattgtgactcagaaactctgtagagaggcgatatgcacggcatggtgttattaaatctccagatagactacttaggactgaagaagctgctctctgattttcacatgtgcgttctggctcagaactttctctgcttgtttgtttaattgctgatctgagactgggactcagggtgatgcgtgtgctaggcaggagttctggccgtggagcacatcttcagccctctaggcaagaatgtcaatggacaagtatgtgcactgtcccttgccatgggcgtgctttataattccacacctgtgaattaatatactgggtgagtctctttggaaaaggaatttgggacagaacaaaccactgaacatgcttggctcttaagtcctgctctttacccatgatgtctgaaaccctgcggagctctcactggcgcctccgataggctctcctggctggcatagatgtgtctgtgacacccagccagaagggaacatctgctcatgttgcctttggaagcagatctctctgcccttgagatctgctccatctgagaggaacgcacagaagctagagtctcatgtgtgtccctgaatggcttttgggacaatctaccctttctgagttctaggactggctgaagtctgtggtgctgtttcttgtaggagaattgctgtgaggggagtgccgggagataaaggccatggcccatttcttcagggagagtttgtggtgtctcctacagggtattgctagtttcacactgaagactggtgggcagggctaggggtgtagcttaattggtagcatgctaacctagtacgaaggaggacttgggttcagtctccagcacagcataaaccgggcctggcagtgccagtttataatccctggtcttgggaagtagctgtggaaggatcagaagttcaaggtaaattttagctacatagcaagttcaaggctagcctgggctacaaggagactctatttcaatcaactaaccaaccaattaatcaatgaatcaatcaaaatactgggggcaatgagcaaggagtgggggagtaggaatagaaaagagaagagtaggctattaccctcctgctttagaattgctcatctgcttcttattcagaggaacaacgatgagaaccagaaacattgaatggcttctgagatcatctgagaacactgacaattattcttacagagaccctgaagggtgtgtgtgtctgtgtgtgtctgtatggggtggtggccgaggctgagatgtgttctctgaggcatgaaattctacctctttcgaagagaggctaaattcatttgcagctggtttcccttaacctctcctgacaccagcactattccagaaaaccacggaatttcaaaatagaatagaaatcatctgagtgtgagtgtgcactccagggcctgggtgggtttggggggctccagcctcagcagttttatccacccctggtgaaggttttcacactgcgtcaccatccttcctctatttgctagatgctcaagtttaagcctgggaaaatggagatctggatgaaacaggcctcaggggactacagtggccataaaagccaaacaccagcccaagccagctccatttggtgtgacctctgatgactggctggctctcagttggtgtcagagaaggcacatggtggcaattaagtcccaaagtgacattgggagaattatgctagtgagaaattgattttttccctccagtcttaaaaaaaaatgcaatctgtctttgtccaaatatttctgaaacagcaggcacagcaacgtaaggatgggttgctggcatcactgtgaaggcgtgggaccaagccaaagagggagaaggcaccagggaggcaagggatagcatcctttgatactttctcacgagctgctagcagtgtgattgtagggggccagtgagtggggtcaggggtggcccggctctcctctgaggctgaggaaaaggagtccccccctcatccacctctgtccttccgactcgactgccctgctttatgctctgtgtttgcatccagcttttcacacgtgaggagctcaggcaaccaatccaagttttcagtgcttctgagattcaaatgtgggttttcaaggtaatgttaaataatgattttcagatcacttgaactgtgagggagctagaatccctgagctcttggtctgcaaactgatcaaaattgattaattctgatgcgtacttagaaagctttatttttttatttttgaggcagggcctcatgaagcctaggctgacctcacactcgctgcatagctgaggatggcttgaaaactctctctctctctctctctctctctctctaacttttatgtctgtttctctgtgtgtatgtgcttgtgcttgcacatgttcactggctacatgtgtgcaggtacctgtggagtcccagaggaggacatcagataccccagagctagagttagaggcagttgtgagtctcccagtatgggtactgagctctgttctcaggtcttctggaaaaggagcaagtgttctaaactgacgaaccatgcagggatatagccctgaaacgtggtaagtgccataggaacttaaaataaatagcaattcctccaagcgcccgggatcctagttgtagtcggtggtcaggtcagtatgttcacctgcataggaagtgagcagtgaaggctaagacctgttgggtgcaaattagcgaggggagagagatcaatgatcataaccaataacaggtaaggatagtgctgcaggggcatgtccagaaaggacacaactcatggtagaaagagaaactctggaagacctagaagaaaatgaaggttacctttcatctgctcttataagaatccttatccaaacctaacggcaagggaagagagagccgtgaacacgactgacaaatgttaaatttcaagaatgttcatgccgacccagctgtaaagctttgaaagggcacaaaattcaccgaccgaaaggaaaacagataaagtagaggatgcttttcatacttttttttttttgagggaaaacttcaaaaagagcagcctaaattaatgagctacaaatgacactcaacactgggaaaataatgttaaatgtaaaaagtacaacataataacatgcccaaccccttgccttcctatgaaaaagcttaaacatcaagtaaacctgaaagagttttgcttatttttgaagcagagtctcaccatgtaaccctggcctgttggaaactgggctgacaacagactcgaggagatccgcgtggcctgcctcctgagtgccagggttaaggctttttaccaccatggccagcaaaatgaaagattttttttttaacagtaaattactgaatgccatgaatgcattaagctatgaaagtcattccatatttgctttataacacacccacttctaattcaacaattttcattttggggtgatttttctgcccaatatctgcagacacctttgcttgagcagattagggtgagggtctactttcctactgggtagaggccagaggtgggagtcagtgctccatatctcagggaacaagtcccactgcataacaaatagcagccgtcatgtggttagggaacgctgcatttgttcatcgtatgtaattcatcttcatgtatttcaaagatgaacatcaatgaatgttcctttgaatgtcgaagtatacatatcatttgctaggttttagtgcttgtttatagtggttttctttctctgtgaaagttaatcatggtgtaaaacagaatcttaagtatgttaaacatgtcttcacagagtttttggcccatgcacacacctgtgctgcctaggccctgtcaggtacagaacattagcacatccccctccctctctctaccagacacaggattggtctaacttcttctcaccacagatatatctgttctaggactgtacataaatagaacactaaagtaaattgttccacagtatccctagagattgggtctaggaggctttgctttccaggggtcggttcccttatattaaatcactatctatctatctatctatctatctatctatctatctatctatctatctcatatcatcacagtatgacttataataccaaatccatgtgtgtgcaaaagatagatagatagatagatagatagatagatagatagatagatagatagatagatagatagatagaatgtgtacgtttaccaggaaaggctatagcaattagatccctgggcaggaaaaactaaagtcttccaggagagtagtacaggctcttaactgctgagctgtctctccaacctcatgataaaagatctacaagtaatctttacactgtattgtccagggaatgacagtgaagaaatttctacatgttcaatacacttgttttgcttttatttcaaatatttccaaaggttacagcagggtttgttgaatctgtggatagggaacctgcagggagcaggacagaatctcttcccttttgttgagccagctaatgaacacagcaaggcagccctcagggtgctctgtgtgtctctgggcatctccaaagcctgctaaaggagtcttgagtttaacagtagttttcataataatgccttttcccctcgaggcactgtgctgacgacatcaggacatcagcattggtggtatgaaggcaattgttgctccaactgttgctgcctgggctgaaggggccatgacacctctgttgtacttttcattaacagtcacttgtagaaagatgagccagggtcagtagtgtccatgttaaatctaagccccccagaacaagtgctctggcattaacagatgtgactttaaaggtaatatgtaaggcatgcctgcacaaacatttgcaagatctgcttaacttggaaccactggtgacataggcatggttctattctcacatggatacaagttccattccaaccaaaacatagttacaatgagtttttatgtaacaaagcacaaacgtttattgatatggtttctagttttacattacaactaacttttaggaacccaccatttgtggacttttggtttgtaccaaaagccaacagccatcattatctagatggctattaacatagcccatcgttttccaattacatatctgtagggtgctgtttacacacatctcccacaagaatgtagcacagcagagtgagtgtagggggaatgtgagatcactgaagagatctgcaaacgtctttgaaaagaggctccataatgcttgttcattgttgtttttaaacttggtgaaatagttaattttctcaaaaatatgttaatttgtagtgagtaaattaacacatattctcaaattttccatttttaccttctcttataaaatgtaatacatgttagtaatctcgtgggttctcaatactttagaatataaagaggtcccaagaccgctgaatttgagcatctctgatttccatattccattgaaagcatgtccatgtcgttttgaatgtcagaacttcgctctttttaattatgggctgtgttccgtcctgcacatttatcatagttgtttattcttcttttaatagacatctgggctgcttcaggatctggagtattgtgaacagaattatgtccagtcttatacaaatgtttgttgaacaggcttttcttcctgaagggtaaatactgaggagataaattggattagtcaggatgcaagtgttcagcattactgcgtaagacattccttggtgttttaccatctacagaagtttgtttgctgctttacatttctgtacaacgtatgggtggtaagagcatttttaatgaaattaaaacagaagcatgcacgcatgtacatacatgcaccccccccccccccccccccccgttctcatctgtgcgactctagaatttgtagggttaacataacacggggtaaaactggaggcctagggtgtagctcaatgtagcccagcagtgcaaggctctgggttccacccccacagccacaaagcaaagcaaagcaaaagaaatcacaaggggagaaagggcgtgaggcacacaggtacctggatggctgagaccttggacaggaagtgctgccacgctgtgttctgccttctgaaggtcaaccaatgcgctgtgcccaggggagggactaaggcagcttctccttccaacaggaaatgctcagagtatccacgccatccccccaccccctggtcgtggttgctgtggctacaggtgctcctctcattcttctgaccctctggattgcaggaggcctgatgggagcttgctttggatgttcatgcaagctgcatctgagcccaggaaggagcccattgctcctacaatttaatagttcccaatgggaataagcagctgcttttttgtctggttacccttacccaactaatttatggctctcttgctaggaattcagtccctcagaatccaggcctgtgcaggtggccgaggtgagagctatactcactgcagctggcgtcagaggcaatactccttttctagttcttggggtggaatttaagcccaagtttatttacccttagcaagcacaactaacttttcttcttattattattttagggcattggataagaaggctcataaaaaggaggacataaaacagcttttactgacacacattatgctgatttatctgtgagtgggagctaaaccatatggtctagattctcttaaaacacacatggggttcaggattaagggaacaggcactaggcaaattaattttgcatttcaggaaacagaacaagggcgttcggtagtccatgattgctgtgtgcaagaaactgagtttagcgattcatactcacgactttgtctagtcccccacagcgtccccgtaataggctgtttttgtttttgtttttttaaccagtggtagacacagcactgggtgctgggccctgagtaacataggaagctgggaagagctagaatccaggcttcgtcccacagtgataggcttccttcctaaaatcttcagatcatgaaagacatgaacagaaaatgggatggactcgcagcccacagatcagccaaccagcccaggtcgttgggtaccatgtcatgttcttgtgttggctggagctggggctgctgaacgtcactggtcagggtttctccatgcttgcctgagactctcagctgagtatcactgcaggatcatgtgctgccggtgactctactatgatgtcatttcattcatgggttgaaacatcctgaagatagatgctctgtgggcagctcagtgcccatgaatgtggcccaaggagaccccgggtgcttctgcgttccctctgctccctcgcaggcgtctgtgtctctctcactgctttgccaaatgactcttgtcctgaatggctttcagggactaatggcaggctgggtgctctaacccacccatggcatgggcagggatttcaggttgaactgagccaaggaacagtcacagacaggaaagaaatcctattgatggcctctcagagtgggagatggctggtcatataagtttggacctggagtttggatggtgtggtgacctgttcatagtcccggcacctgggcagcatcagggaatttctgggacaagctgggtagctagacaagccaaatttgtcaaaatagcataacttgaacaaaccaaggtgcaaacctattttgaaagacatctttatgtctttgaaattaattggacccgtcatccaattggatgtgtccaattaactcttagcaaataaggatatttgctaaggaagtgttacaacagcataatcgggccaggttgtagtgttcccaacaaatccaatgatgtccgtaccactagaagctggatttataaagtgtggagggacccacagaagcagtgagtggaatatcgaaaaaccatgccttactgaaatggaagtgtgtgtgtgtgtgtgtgtgtgtgtgtgtgtgtgagcgcgtgcacgtgcatatgttactgggatcaaagctagaggcttgtacatgttaaacaagagcttactactgagccacaccacacacaggccaatcatagggctttctaagaagagaaattttgtatttggtaagttttaatgaaagataagtacatgtgggtttataggtctataggtcttacagatataagatatatcttgtggtattaaagacacatactcatcatagttgactttcatttgtgacattgatgaactcttccctcctttggctctctagacttggggaaagccctagcctagagatagttgtcaagccagggcatggatgcgctcactttcccctctgaagtcctgttgggtatctgtaattgatcttggcaattcctctttttcactgaactccataaataaaccgcaggtttgtgctcaccacagcacgccccaaagccatcccttgtctgtctgcatttgccagtaagtgggaattgccatccttactctaattgcttgggtctgtggccttattatgtgttatcttcatctcatttgtagagcgtaatggcactgcaaacatagcatcgcaacaggaatggcaagcccaacaagagacactgggtgcatttaattggtcaatgcacagtcgtgcccttcgagagactcacacatcgcagaaggaatgtcccagtatgtccaggaggttgcagaggctgtagtatctctagagctgttgtggacagacctgctttggggactggcaggtctttggcctcctggcttggggagcctcagtctccaagtgggaaaacccttttctccggtacttgttaggggtgtggcgggatagtgtaccagtgtactcagctgtgatccccttgcatggactaggaggcttttgtggtgtgagctcagtgggggggatcctttgcagctcttgcaacacaggcctgccattaatggtttctaagagaatgagagagcttgctgtgtcaaaacacagtgcctccctcagcagtcctgggccccttagccaatctgctggatactgggtggcccagaagccagctctgtagggggccctggcctaccaagtctttctgaaggtggtatctgagctgtttcccaccctattgtttggtaacacatccaactggtgcctgtggacactgtccatggagtcccccacttctcactcttttgggccaggttggtgcctgtggagagacagcactggcctttctttgcagttgatgtattcaggaaaatatctgtagatgttctgtttaaaggaattaggccatatttcaagattatacttcacaaggccataggtaagggtgtgtgccctttaccaagtgaaatttttaatggttcaataggatgtgccattcagtgttaaaatgagctcaaagcacagtcaggaggagttcacaaagtactgaatggctctgtgtggtaaagtttattagagacaactgggctacagtttcaaagacctcaagctatccccgtgctaaaggggaaccatttgtatgaccttagttttcttatatatcaaattttaagatggaggagtaaggtggtcttcagtctgggtgagagtggttctacaacaccatgatgttgcagtttggtggcccaaggagatagtgttctcctctgtgtccacaaggcagcactggggactgatattaagaatgggatggatgaagcagcattgggggcagcaggtaggccacacccttgtggtcaggtgtgtatcagcagaggcgacatcagcaatgagcagtgtccccatggcacttgctttggggaattggcttcagtggctcgcctttgcttgtgacatatactcacaccacatcccttggctcacttggaggctcatccctcatccagttagcccctcatgacaggatgacaggaatgaatttcctgtgaatcctagaatctctgaactttcccttgagcctgacatgcctttctgtggtcaggaagcaaagcaaaaattgccactctgctggatttaaaatagtatcatgaatcttacagttgtgtgtgtgttagtatgttatttgttcacggtctctctgtgtgaacatgttctctgtgtgtacacatatgtgtgggtatgcagacacatgtaagcacatgcatatgaaagtcaaaggccaacagccatgtattacccaatcactctccaccttatgttttgagacagtggctttcactgagcttagagcttactgattgactggcagcaagctctagggatcctcctgtcttctacctccccagtgcagggatcacaagattatactgcctggcttcttatgtgggtgctagagacccatattcaagccttcatccttgcatatcaaggactttagtgcctgagccacctccccagccctattcttatttttaccatctattttgatttttttgtatatgttccaagggttaaaattcaagtcctgtgtttgttaatatactttctcctatagccacccaatgaatggtgctcttattttagatttatagctatgcagtgactctaaacacatatactatgccaagccattaaagagttaaatgcaaatgatgccatatacacaccattctggagttggcattgttcctccatatatggtaatgaaatatagtccagctgctacatgtgtatgtgcacgtacctacatgctgacaactaacacacataaacagtaggacaaaacctagaatacctttattcaagtttaaagcttctgtctcattgtgtaaggaagtggcttatgtgcttctgttgactgacactgggaacggctgctttcgttacctaaggatgcttatgtgtgcactcttgtgtgtcttcttttgcatctacatggaaattctttgtagtactttagcagagtgtgtagtaccaagccgtagactcttcatgttttcaatttttttctttcttgccaaattgctctccaaagaggtcgttctaatggatgctcaccctgtttgtgctgtgctggcccggcacttgttcttgtcaaacctgaggtatttgccaattaaatgggagtgttctgataactcattgtggtggattgcattcccttgatcccttcggagatagatgttggttgcagatacatccagggttcttccttctgagagttacctgtttatacactttgcatattttgtctggtgggcgtgtgtcttatgattatctagaggtccttcacacattctacataatcattgtttttgttggcaccatctttttttggtcttgtttaaagagtttcctgttataccaaagctttaaactttaataaatatatattttttgtcccattgtttttaagatttaattttattattttcaattatgtgtaggtgtgtgtgtgatatgtatctgcatgtgaaaatgcacacatgagtacaggtgtccttggagaccagagacattggacccctgaagctggagttacaagttgtaagatgcctgatgccactgctagaaacctaccttggatcctctggaagagcagcaagtgctcttaactgatgagccatctcctcagcctcttcaattcttttttttttttttttcgtttttgtattgatttttcttgtcatactcttgtagctaggatctctagtaccatgttgattggagttatgatggttctgggtatttctaagcttctgttagtttattaaatatgatgtttcatttgcagttaaactgactaaatttttgtgagagtaagaaatgttcaattttacttcactagtatttcaaaatttttatgaatggaagttgaaatgttttttctatatttatcaaggagatagtttttgtccttaatattaatgagaaagcaacataagcagacttcctaatgttatactgttcttttgttgtctgtactgaagatattttgaggttggtcatggtagcacatgcctgtgattcaagttgggagcccgaggcagaaagtttttgagctcagggtcaacctgcaggaagtctatgtctcaagaaaccaaaacccaaaccctgtaagttttatttagatgtgtcctagtttgctttctattggcgtgatgaccacggccaaaggcagcttggggaaaagtggctttattttgccttacaggtcacagttcatcattgagccaaggcaggaactgaagcagaggctgttccttaccgcttgttccccatgggctgctctgctggctttcttatttgacacaggaccaccagcccaggaatggcaccttactcagtgggccaggctttccacatcaatcaccaatcaagaaaatgccctacaggcttcccacaggccaatttgatggagacagtttctcaaacaatacctcctctttctagataactccagcccaagttgagttgagaagagctcaccagcttgagagtttaatgtgtattttcatgagtggatatggctggtactttttgtagtcttctctcttggttagatctcagttctcttaatattaccacatcagtttgagactgcttcctccttttctgctctcttaaaaagatcattacaacttgtattgataaagtttgtcagattttacctgtaaaggtatttggacatggaagattaattatccatcaattagtcatccaccaattaactaaccattaattaatccttaattggtgattaattattaattaattaattttgattaaacaaactttcaagacaagggtctcgctatggagtccaggctggcttcaaactcatgaccctttttttttgatctcttgagtgctgggatttcagcatgcactaccacatctaatagtcaggagaatcatgtgtgtgtcaattttaagtcactaatttcatatttttaaatgactatagaagcgtttgctgtttctacttagattatcaatttttattttattatttttatctctatgagtgtttgtctgcatgcatgcctatgtatcacatatgtgcatggtacccaaggaggccagaagagggtgctggatgccatgtaattgaagttacagatggctgtgagcacccatgttggtgctaaggattgaaccccgtgttctctgaaagtgttgccagtgctcataaccactgagccacctcccaagcttctctacgacctacttttaaatcatacatagaggaaacattttattatgtatatagaattttcagtcattctttttctctttaatattatgggtattttgacatcattatacagtcactaaggagacagggttttttttttttgttgttgttgttgttttgttttgttttgcttttgagtcagagcctttctacataagcttggctgtcctgaaacttgctctgtagaccaggctggcctcaaattctcaagtctgcctgcttctgcctcctgagttccagaactaaaggcacctggctcaagaagacagcgcttagaatccttgctttatgcatttgctcatttttgtagttgtcatttaggttgggtcacccaagaacaaaggctgtcacttgcagctgagaaggtcacttgtgtaatgtatgtagtgtagttagcaccaggaatcagagcagacactgatttctgctgacatcatgttctagtctgaccagacactggtcacttcccagaaagctgcgatttcctcgtgcttgataggtcgagggtaaaggtcgccatgaaaatgaactgtgcagggcagggggtgggggtgggggttgggggcggctttccttttcctgagggaagaggtgacacaatcttttggaatgccggcttaccctgaagcacatcctgcctggacagatgagctcagggatttgggcccaagtgggttctgttgagagatctttgcacatagttctaaaggcacacaaagatggtgggattgcagttctggaggacaggaactggaaggacgtgcaccccactccccatggagctcaggtcctacagcagtgtataacactctgtgaaactattcttgatgtccgtggaggtcaggctccttactgcccacgtgacctcacggtgctgtgtaggtgaagtatggatagctccccctcccaagttggttgcgttgattccgagtcttaaatccccaagagttttgcttctatacctgtttttaacagcagcaagacactatctcctcctccttccatgtccttcctctcccctctctctcctcctctccttcctccttctcttctgcctccttttcagtactggggattggatccaggtattcatgcatgctaggcacatacttgaccactgagccataccattgctcccatttacctactgtataaatggtccaaacattccctctgtctctgttcctgcctgcccaaattattgtgtccagctttcctgcatcccatgtcctttgaagactctagaatctctcattgagttttctcaattggattggatcagtgtgaaactcttttgcactgaattcaaacacatgattaggctgtcgatttctcattttaaaaggcagtccccaggcccaaggatgtgactcagtggcagggcatgtttttagtgtgtgcaaggctctgaccttaatcctcgatgatgatgatggtggtggtggtgatggtgatgatgatgatattaataataattatagaaataatggctctccatgatctctatctgctatttctcagaaacacattgaacccctacatatcacatatgtactttctgctcagctcagtctgactatatgccctgtcaccacccactgcccacacctgactgaccaaccccatgatctgggcctaaaacagcactacctctcttaggaacagcaatttgtctttggttcagattcctttattccaacagtttaaaaagaaaagtccttgcaggtctctacaaatctcacatctaaagctttatggagcagattatttctttaaaaatattgttgtctttgtcttcctagcagatagtaattttgaaattgttagacacacacctgctggcaaaggggaaattagttttctccaatggagtgtcaatgggtatttcagccacatttcagggaaggccccatggcaagaagtagctagccaatataaaataggctccgtgtgtgtgtgtgtgtgtgtgtgtgagagagagagagagagagagagagagagagagagagagttagagttgtatcacttagttttgctttggcattttttgttttactgggtttttgtttgtttgtgtttgtgtgtgtgtggggagaatacaaagttatgtgggaagggattagagaggtggttgtgttgtgggaagagttatgggaaggggaacccatgatcaaaatatattgcatgaaaaaaataattgaattaagataaaaaagaaattgttagccagagagatttcccactgcccctttgttcttgaaactctgagtgggtgaatgggcacagcctcccccccctcagagtcactcaaagccacaggaagggggcattttgcttctttccactcttgatgccctactgggcactctctgctcctgccccattgttctagacagcctgcagggctggacatgcctcccgctaggcatacagctaagccagcaggcatgaaaccgccatatgcatcatctcaggacacttggaagcagacagggaatgtgagagtctgaagggaactttgtctcccactggtccagcccaggaaactgagtccaggttgcgttatcatgggttgcggtgctggtggcagcctctcccactttctgcacctttggggacttggttggctttggatagcacctctatgggagggagcagatgagggaacctctgaactatttcagtacacctttcagagagtgagagggaggggatgcagagctccccttcattgtccctggaattcttgttctctttgagtttctctctgggggtgcattgtctgagtgtgtgatagatgggcttcctggtgcctggaagtatgttagtagaggttgctagaagctgagagcagagatgattgcttctggaggtgagtcaagacgcccacttccctttgacctggtggtcccaggaagattgacagggcacactgttctagacaattctagactgttctagactattcagcatctatcaccctccattccctagccatttccccaccgtgatcatgacccatggtgtttattgagcacccatgcacaaagtcccagcatctacagctataacacagagccagactcccaggaacgactatcctccacccttggaggcacgaccacatatgagaagtcaaccccacacctagctacccattctggtgaggcatagcttctaagaccaacgtccgtatgggaaggggaggtctctacacattttgagagcagaagctgaggctccgtcctaacctgaggggctcagccagctttctgtgctcccccgtggacaaaccatggtgttgtctttggatcaggatcaaagctctttctccactaacccgcagaagagagccggcaaacaaatgggagccataaaatagagagaagttacagtgaaagtttgtctgatgcgattagcagctggccacctgccagattccacctgctctctctggcactgtggtgtctcctcatggcatctgacccggggcctggggcaacaatacgctggtctgtgccaaggataacagtggcatagcagccccaggagcaggccatgagggcaacagcatgaggtcagagcaagcagggcctgtgggtggggccatgacaagaggccatgctgcacaggctaagggtgccggcccctgactcaccctgagtctgggaggttacctaacatgtctgtgcttctgtttccctctgtgagaacctgctctcccatttggcaccctctttagccaactggcaggaaagcaaagccacgacacctggaaatcacaggtgccctgcgtgttgtgcaacaggtaagcgcccatcacgttgcagtgacagtccctgggtgcagaaccagctcggcctgcggaggagggcaacccatgaagtgactgaatcagtaatgggtcatgagatcctaggttgggccagcatagctgtatggggttagcacattgcacagtcgccctgagccatactccgcttactgcggtaaggcgggatgttggagaggataatttcttaagagactttcctgttggttttcctttaaatctggatttgtacatgctggagaatactctacttcggagccatgaccccagcccctcagctcattctgccgtttgcctgtctgcttatgtcactgcctgcctgattggtgggaaagcctgacacacaacctcaaaagtcctctctctggcatcagtggatggccactgtcatttctctccagacagtgaggaccagtgccccatcactaggactcacaggtgtcagttactggcagggttgctggggtctgttcccgtgaatgtaaataccctggccaggtcagcagcagtcacaaagcccaaggaagtgagcttgtctgaattgtaaaagtggaggaggggtctgtaagaggggcaaaggtggggtggggagagggggctctctacctcttatccctgggaacattcaccctttgagtaatacctgaagaccagatgtttcagaggggcttccctgctgtgtactaaggtggagctccaaaggttggtgaggtgagaaggagggtacagtcctgctaaggttccttatgagagagccgatcctcctcctggactccgcctactcccccttcagtgctccccatgcaaggccttaagagcttagcctgcagataggagaggacttgatctgtgagtgtgtaggactcttgaagaattttattatgtctcccttcccctttctttcctcaactccccccatttaccccaactttgctgtcattcaaattcatgacctctttttctttgtaatctgtctgtccatccatccatccacccacccaccatccatccatccatccatccatccatccatctatctatctatctatctatctatctatctatctatctatctatcccaaaatacatagaaacagcctgcttagtccaaatgtgtttataatactggccattctccatggccttgagtgtttcatcatgaggctgtgctccatgtacacacataactggctggaattcccttcctttgagcggtaggaaaagggaggctcttcatacactctggctttcttttgctaaatggaaatgtcacgagagagtctgcatcttcatcatcccccccccatattgggcctgtgtggggtgagtgtgtagcctggactcttagcctccttttgtgcacagccccagcacagaacagtgaacacggttctccatagatgtgtactgatgactgcttggccaatggaggcagatgcccactcttgacactttgtttgttttgtttttgggttcttgacatgcaaagtctaaggtctggactctggatctgacattaatgacatctctcaccacagtagcttttctcatgatcttctgatcactgagaagtgctgtgaacatgttgaaatatcctgtcctgtctacacaggggtgtgggctactgcaggtgggtcctggtgtcagtactgatgcccgtgctgatgggcaggttgggtgtgcttgtgcacttgtctttggagagcctcattttcctcgtgtgtagtatgcacacccaagtcactattagagggaggaggagcagaggggcagccaccaatcaaagcaagtgtccggttgattgaagaaaagaccagggacagctgaggtgatagcctggggcagagctatgcatgtgacttgatttcccaggtgatagctacttgtttaacttgctagttggctcctaagggacaaagaatgatgtagggaaggtctagacatctgcctgtgattttactttttaatttcttttccaggtagagtcttcagtggggcatggggggggggatgctggcttcctggagggatctctcaggagtctgtctctggcagtagaacacaatgtttaaaaggatgaaaggtatttcatgtgcgcacacacacacacacacaggcacacacaccaatgttcagggtttatttaggagaacattctccttattctccatgtgtagttggccttcattacctgtgggttccacactcatgagttcaagagaccaccagaggaaaatacttgaaaaagtaattagatatgtagtgagcatatgcaggccagtagtccccagacaactatccacatagaacttacgttatattaggtattataagtaatccagagagggtttaaagtatatgagcacatgtgtataggtcatgtgaaacattatatatcaggagctggagaatctatgtggaatttggtatccatgggatcctggaatcaagtgtgactctctctcttttattattttgccattacctagattgcctaaaagtctctcaaagggaaaaggaagtctaatggtctgctggaccacttaactctgaatcccctgaaggcactactgcaagtgacttggtggggatcacccttatcatcctcatcctcacttagaggcaaaatgtgaagggcctctctctctctctctctctctctctctctccctgtgtgtgtgtgtgtgtgtgtgtgtgtgtgtgtgtgtgtgtgctcatgtgaccttagaaccatatgtggtacatagtaatacttaagtattcattgttcttgctcctattatttttgggggtattctttaaaactgttttccatttcattgtgtgtcagatgttttgactatatgcaactcatgcctgcagtgcctgggaaggccagtagaggatattggatcccctggaactggagttacagatggctgtgagccatcatgtgggtgctgggaatcgaaccctggtcctcagcaagaacagcccccttttgggtgtttttgctttccccgccattgtatttctggtgttcagtggctcatttaggcagggataagtgtgacaagggacctatacggttctgtcagacttacaggccactgcttttagagctatcgaatggcaggaggtgtgctcatgggggggatggcattcccatcagtgtggatgcaaagactgcgggtgtactcagcacagactgcgtttcctagcctggttattaacactaactgtacttcgttacccagagctcaaacccactgcttgctgcttgctgggagaaaagcagagggcctggtacctgaagccattggtgcatcatgggtcctgattctgtgtctgggttttgcattctaatacatccccttccctctacgatcatcatgtttagcgcagcggatgagctgagaagtttagtgagatatacatggatatatgtcacgaactctgatttatatcaacaatctagatatatgtcactcagaaatatatcccaaactctccaaggaggtgtgcagatgcatctcaggcattgtttgaatgctttgaaaactgatcttgattatcaacttgacacacctgggaagaggagacctcaattgaaaaattggttttgttaagtcagcctgttggcatgtctggagtactttcttggttgctaattgatgagggagggcccagcccactgtgggtggtagcattcctggtcagatgggaaagatagatgggcaggcataggagcaagccaataagaaacgctcttctgtgttctctgtttatgtcccagccttggcttccttgctgataaacaagacaaacgcttgccttccctaagttgcttttggtcatgttttttatcacaacagaaacaaactcaacaaatacttagtgctttggaggcaataaattaggtgtggtgtgggaagatgaaaggtaattgattttacttgtatcccgctctcaggaacttaggccagtttggtccagaagctcaaagacccctaaaatccttagacctcttgggagacatgccacccattctttttaagaataataattctcatagactattctctgagaactaagtatcagccatccagccttggtgtattctcccagaatcatttggggacaaaagaaaagaaaatttactcaacagatgtcaaaacacggagcaactggtatggctaaatgagtgagctcactagttctgtcatctgtaacctgtctgtctgtctgtctgtctttcttgcattcatgctttcctcccttcttgtcagtgtccccctgcccccatcctccagtatttagatgactaaactcacagatggtgggtctgtgtttttatgccaactgattaaagaattgttaaggcagatttagtcctctaaaaacaaacacatgcacaatggagatttggggccaaactttgcaagacacaatagtgtattatttctttcttgaaaatgtattccaagactgacttagttataaaacagcagtgcccatcattgatgttatgatgtctgtctcctcagagtttgaagctgctgaccacattttagtaataatacttatttttttcctttctcccatcatgaccgtcatcctttgagtgattgtgttggtaaatcaagggattggatgcatgagtgagcatggtgatggcttttttttaaaccatacctgtgacttgcagctaaacagtgacagtcttgtcacaccttactatatctttgttttcttgaggggaaagggggaaccaaagtttacttgccccattattgttaaccctgtatgagtgttattcagagaaaatgcaaactgttggttttggtctcatgccagttggttccagattttgttcttaagagagtgtgtgtgtgttttatgttatcagtttgaaagaggaatgctttccaggatgaatccagccaaagataggtaaaaaaccgattgaccacccccccaaaaagaaaattacaaaacaatttttaaaaaataaggaaaaactgtttaaaaagctgagaaaatgatctaacaattcagcacaattccagtgagaatcagaactggatttgaggaagggaattacatgctgtttattaaatttatatgacaatagagaaggtgatgtaaagctataagcagttttcattgctgtggtattgtcccagactggctggcgtcagaccccatggaaggagggttggcttaccacaggtgggcattgtagacatccaagggaacaaaggtatgttcaataaagagtgcagagacatcggggaagccataccgaagagcagcaatgaaccaggtcaccacctaaaataagcacaaggaattaattccagttagactgagcacttaagagtgaaaagcagactataaacagtttaggggaaaaaagtgggaagatacttttatgaccacgtttagaagacataaaactagtgaaatgcaaaccgtgaggctgacaagtttgactgcatcggagcattagttcatccaaagagcatgtcacattgaaaacaaaccccacaaactcaaagaaagtaattaatatatgcatatataaggacagggatatatattttcttctctggatattttctttatttacatttcaaatgttatcccctttccaggcctcccctccagaaaccccctatcccatccctcctccccctgcctctatgagggtgctcctctacccacccacccacccactcctgccttcctgccctggcatacctctaaggacatatattttcatctgtgaattttatgatgttaaaataattttctctagttcttacattgtatccttttcatgaatggttattgaattcagtcaaatactagtctgtatatgttgaaatgatcatgtgattttttatctttcactctgataatatggtctattgcattgattccttttgtatattgaaccatccttacatccaaaggctaaatcctgctttgtcatgttgtgtggtctttacaatgtgctgtcgaattccatatgtgcatatgaatatttgcatatatatttattagggacattggcctgtatttctttttcttttcttgtgttttgtttgtctggctttgttatcagggtaatgctggacacaaacgagtctggaagtattccactctcttatttatttgggggaaaattggaggaagactggcattaattctttttttgaagttttgctagaagtctccaccaaagccatctggtcccaggcttttctttgttaggaggttcatagttactataaatatctttaaacctatttatacgagaattaaaatgacccacatgccactgttgaagtgtggttgacttggaactgcttatatgttgttgaccttcatctgagctggtggtgatgaactgcctttgtttctttgggaaaattctcctattgttggttggcagttttctcttttccagccttttgatcggaagctactgtcttactcccttctggtgtgcaaggtgcctgctgaaagtctcctggcagccttgcaatggctctcttggatgtgaaatgttgcctttctcttcctcctttcaaaattctcttttgtctttcagccacttgatcatattgtgtcttggtgcaaacttctttgaatttaactttcttatatctggatgtccatttcctttcactgatttgaggagttcgctgacattatttcttctaagaaagttctgcctctgtctctctgtctactggtttgtccaaccttttgaaatcacaaagcattgtcatttacaaagttcaaggtcaaggactgtacaattgaattacacaaataatctcaagaaaataataatctcgagaaaacacatgatgctttaagtaagattatagttttctgttggctgtgttcatagaagtttgggcattcctgactccttggagactcacaaatgtgtgtgcactgtgtcagttgatggcgtcccacagtgccgtaaaagtagactttttaatttttttgtgcttctcagattggataattttcaatgttctatttttgagtttgttgattcttgcttctgtttggtcaaggtcaagtctactgttgaatctatgtagtcaatattttagtttagttattatattcttcagcccaaagtttttatttgattattttcaaaatagtctctcttggttgataattttattttgttcatgtgtcattttttttcaagcatattggtgtctttgtgatggttgttcctgaatttgttagttaacttggtaattaatacatctctattgctttaaagctagtttccagagatgtatttttgatcatttgatagggctttatttctgtgtgtacatgtgtgtacgtgtgtgtgtacgtgtgtgtgtgtgtgtgtgtgtctgtgtgtgtgttgaatccttgtaaaattagctactgttcctagtttctatcgtctagtttcacacaggaaaatcttgaccagccagctcaccctgaattcccggggacatctggtgcctcttctgtagatttgtcttctccggacttgtgtttacacatctccagttcaagctgcccactaggttccctgttccagctgctctctctggtgagcttaactgcaggtcgcctggagcttcgtgacagagtagctctctttagtcaccagcagcctccagatttccagggtaaggatggtgggttctgtcaggaccctgagacaggaggacagaaactggctccccagagggatgcatgccgcagctcttccccagagggagaagtgtgactgatgcatgctgggaatttccccattggttctgctaaatctgattttgcactttccatggagtccagaagcttccttaatttgtttctggattcatcacaaaaggaaggagcgcatacattattaggtctgtgtctgtgtgggaatttgccttcttgcaagattacctcacagggagtctctacaaggttttaaatgagctaatgttcttgatgactgtccttatgagaggcataaaggcagaagatacgaagatacagaaaaggctgtgcagagtggaagcgatatgtccttaagcctagggttgtttgtgactcccagaggctaaaaaggaggcacgagactgattctccctcggagcctccagaagtagccatctttcctatgaccttgatttcacacctctggcctctaacaatgagagagtatgcagttgtgctcagtaactaagcaggctttgtggtcatttgctatagcaaccttggaaaaccagcacagcgggaaggattatagggagtttcactgttacaggctgggaggacgttatgaatctttgcttagctgccagcctaccctctctttgttcccaggagcctgcctgtgtctggggctgtcatccatgcagtttttttttttggttgagatttctatttggtggcaccaaactgtattcccgtgtcctggtggtaactgtcagtggagcgtgtgaggtgaagacttcaggaccatggcctgcctgcccatgacaactctgttttacatgtgttattttgggggcaataaggaaataaaaacaaagacaaaaaaatgcatggtcgggggctggtgagatggctcagtgggtaaaggcgctgctgtcaggccaggcagagttcaatctcacagtggagagagagagccctctcccctgaaaatgtcctctgacctccctcaaatgctgtgtgtgtcccccccccccataaatgaatgtaatgaatgctttaaaaaggttctgtcacttaaccaatcaaaaagaaaccgtcagagatctgtgttggcttctctctggccatttcttcttcctcagtcttccctgtcttgatgctcttccttggtcagtcctgtttgaggtgcagcggcttctacagtcacagtgacgctctgacactgctttggggaatgggggagaggtttggttcagagccacagtgacatgaaaacccaaagaagctccagcttttcagataaaagccccaggaaattggggctgccctctgccctgcccacgaatcttcatcattgattcttggccccttccggtgagcagcatctaatgggtcctagactggcatctcatgcctaccaatgactcctggccaagcgaggggggaaagagaagtcaggaggagtggggtgaaattactaaatacggagcaaggggaaagtgagcaggcaggaaaattattttgaaaaggttagaggaggaggcagtgcatttactaaagaaaatgccatacctgcattagagcgctataatttcccccccaagtatcgccgtagaaatcatacttcagactctccgccatgcataaatttgaggagaacaatttaccggcgctgctccctctgtgtggtcagcatcctcctagcatcagtcagcgggacgagtttcagacgttattatctgtgctgtcgagtgttcgtttctgtgcactgatttggctgccaaaatgttcccttttcaagccacggacatcattaagtccactttttattttacatcacttatcacttcccagactctcttatttcattactttgcattcagaatttcaggcagaaatcaatagcctggacacaaaggcaggcccctgcactctctgtttggcactgacaattcatttctcaaatcaaagggtttcttttttttttctctctctctagaagtccagtgtgggaagtagctagtatgcctatgaagtcttaatttgcttgagggaaagatgaatttttaaaaagtgggtgtggggctaagcatggtagctcttgtctgccatcttcacatttgatagaggcaggaggaccaggaattcgagcccagtagtctgggttacacagggagaccctgctttaaaacaaaacaagacaagcaaaaatgtgtgtgcatgcgcacacacccatgcttgtcctgtgagggtttccgggtatgcctcagttggtaaagtacctgctttaccaacaacaggtacaaggacccacgtttgatctccagagctcatatgaaacgccagtcgtggtggcatgtactttcgatcccagccctgagaaggaagagataaataggtccctggggttcactggccagcctgctaccgtaattgggagctgcaggccaaggagagagtctgcctcaaaggaactggttggcattcctgagcatgacatcctaggtggtccactaccctcgtcacacatatgtacgcatgcacacacacacgcatgcgcacacgtgcatacaaacaaacaaacaaaaaaataactctttactaaagaggctgtcttctgttctctgtctttcatacactgcaggcagtgcctttctcatcctgtctgtcttctccaaagaaggacacttgtttctgggtccagggtgccctgaaaaccaaccaagccacaactccgccagtcttgctgtgcagcacttagaaacggagcttgttttcctgttttcacgcctctaagatcgataatcgctgctctctgctttgctagatgaaataccaagtaactgtctcgagatgtagctgggtgaggggacggtgaaagaatagatctcggcggctgcgcactgagcccaccacacccaggctcccctgacttagctccgtgctgggactgcgcagcatttccagacaagttagtcccaagcaagggagatgggaaagagtcagtgtgctgccgctgaccatgtgggtggaactctgcgggggtggggggataagaagccccgggcaatcctgcaaagacttgccaaagcctgggagagaagggctcttcttcttgttcccttgtttcagatttttcagagaacagagtgattagtaccctggagtacactcggcacactcgagggttagtgctggatgctttagcccacacctaggaacgatggcagcacaggtcctcaccgactgctgagcagcctcgttgtctgcccaaccctcagacccccatttgcgtacctggaccgatgctttcccaactaccactgaccagtcctgccgtgagcatctcttctttcctccgcactccctaggagaaggggagacctgcctgacaaacttgctggtgtggtgaactcggtgatgtcttgctgcagatagtttaatgcctgtgtagtctttctctctcctctccttctttcccttccccctttcctgtatctcttcttccgtcccccatccttcatggcttgtcttgtgtgtgagctctggatttagttgagagacctcatgccagtgaatagctgtagagtatttgaggaagacgccaggtatcagccttgggccttcacacacacacacacacacacacacacacacacacacacacacacacacctcaaatatgcaaacatacacacacatgttcgacacatacagacatatgccaaacatagacccctagtttataccaggagctggcagaaggcatatttattttccaagcctttctacaacattgttaaaagtttataaacttttcagaacctgtctgaaactggagaaatctatttggccctagaacaattttgcttccatgatgactgcagttttagtacattttattttttaaaagcctgagaatcatatatgattgatttttgtgtacttgctactttcttctagttgctgaattttcacgcaaagcagaatttaaatgtcataaaacttgtgtgtatttgcacagcagcttagttatagctagtgtttcatagtttacacgaatatgcttcctttttctctcaaattatggggacttagctgaattttcaagactgattaagaggttttgtgacctgctctatgggggactgatgtgtaatggtaatgttaatttttttcttaattttaaaatccatttgtctttgtgtgtaagcacacctgcatgtgtgcatgtgtgtgtgtgtatgtggtgtgtgtgatgacatgtatgtggaaatcaggggacagcccatgggatcttgttctctcctaacatgtgattcacagggatccaactcaggttgtatgcttgccggcaggtgcctttgcccactgagccaatgtactgaccctggtgttgcccattaaggacttttgtgtgtgtttgtgatgggaacaaaaaaagtgggtggggggccagggagaagaccctggggaagatggggggggtgagaaatagcccacgttcagccagagttcctgtgctctgggcaggtggacgtggggagagctgccggatactttccacttggctccgggtaggcatctaagcctctgaccccactcggcgggaggtggacaaagggcagcccctgacctgggggccccagggccacaccctgtagccctggcattataggagagagggatgagggaagaggttcccaacactggcgagagtggtgcagcagatcttgaaggagcagagactctctgtggtttaagagctttattatagaaatgcagggagaaagagagatggtagaaaggagagagagagagagagagagagagagagagagagagagaaggctagagagaaagagagaaagagggagagaggagaagaggaaagagaaagggaaggggagagagaagtgagaggtaagaagtaagagcgtaagagagcgaggtgggggctgaacacccctttttatggtcttcactgttgctaggtaattggggagaagtttagcctgaaggtcagaagcttgggccattgcttacatgattactgaccatgcttctcttgtgggggctgtgggaggtgataacttaggcaggggctagagttccaggagcatgagggaacgcctactgtgtcatgtatgtgaattatgaccaccgggttcagacctcagctcgactggagaccagcctacaattccccatatgtttggattcacacaaatgtgtatatgccttgtgtgggcgtggtggttggggggagatgacaaccactggtgacattccttaggcactgtccacctatggtttggcctgggacttgtccatctgaatttggccagactggcatttccatctccatgctactgggattacaagcacaagtctccttgcctgatgttttgtgtgagttttgaggattgagtgctcaagttgcttatctgacaagcattttgctgactgatccatctccccagtccgcttaagtacctttatctaggggtatctgaggctcttttctatgccaacgtgtgtcccagagagaaagaaatcccagcttcagtggtaacctgggacttcattgtgacatcccattctttccatccccagccctgtttctcattgaattctgggttatggtaattatccaatcacgatatttcaggtaaaaagataatgaatgagcaaagaaagacatagctagaaaatccgttgacagagtcaaccttcctgacccaaattgactccttatattgaatgttcccttcaccgctgtctacttggtggcaaatattcctgaaagggactttcatattttctagagattcatgtgttctctctactatcttcccacccgaagccataatatcccattccgagtgtcataaccattttcatagcaactatgtgtgatttcatgggcagcagattgcagggagagagcagtgtgagaagtccaaccccttgggacagggactggctctcttctaatctgcttagcagtcaacaggacatggggaaatggacaacctaagagggttgaggacgatctagcatcatttaatgacctgttctcagtgcccctagaatataaatttaattgggatttatttatagctgacactgaagaacactaaagccattttcctcggaaaagggagtgcccaagaataatgtataggaatatgtatagaagagaactgggattgggctcatggaatatatagtctttccttacagtgtgtgtgtgtgtgtgtgtgtgtgtgtgagagagagagagagagagagagagagacagagacagagacagagagatagaaagggagagatacagagagagagacagatagacacacacacacacacagaggacctatagaactatcacattatagataacagggttctgaacacatttattttagatgtgtgatttctggtttctgaatgtttcagagagaaaactatcaaaacagagaattacatttataacttccctaaaatcggtggcagccacagaggctagagagatggcttgggggttaagaacatgtgctgctgttctggaggacttgggttccatttccaacccccatattgtgactcacacatgtctgtaactccagtctcagggatccaatgccctcttctgccctcttctttgccagatacacatgtggcacacgtgcatttatggagacaaagcactcatacataaaacaaaaataaataaattaaaaaaattggcagcaaaaagagcagcccaaaggctttggatccttgccaagagactcatactgtccgtgcaaccttaatactcaggtttcgatgaactgttattaaagaagggagtttttatgggagagggaaaaaaagttaatccaaatagttcaacaagtctttttcataactcctgcatgtatcacactggcaaatgacacagcaggctccaacagtacttgcttcctgctgagatgagaaccaccttgtctgtgggacctgaggcttgatcagagacattccccataggctcctgtatgggatgggggatgcttaaacttcagctagtgccctgttgtggatatctatggaaccttcaggtggtggtgtctagctggctgaagcagactattgggttggggggacgactttggaggctttaaccccaggaccctggtttatgctttgctgtggccttgcccacactctcctcctgccatggactgagcccctccacctgctcttcccactgcaataggctgactctctgaaacacgaaccaaagtaaagcttccctctctgaaatagtttccataggattttaccttcttagtgatgtgaaagtagcaaatgccctgacttagagatagagggactagtgtccttggatccagcaactgtcagaaaataagggctttcttctaagtcactggctactaattgatcaagtcagcctctttcagatggtgtaatgagattggatattttcccttgagtctcagatgcagttataggatgagcttagaaaacatcttctgtccctggagtagaagactatcattgaagaaattactggcaagttataggaataaaaaaaaaaaaaaaaaaaaaaaaaaagctcagtagaaccctctattaccctcgtcaatgattattattattattgtgatttttctacttagcaagtgtatgggcttgaaaaaaaatccaataaacatttattagtagctcctctttgcctgatagcagaaaattagaaggaaccagatgcacccactttaattaattggtgtaatcaggagtggtatgcagcatcaagggtgaaaattgctaacttcaattgtggctttgtggctcaaatgagtttctgtagtcttgaagtctttgttccccttgaataacctcatagggagtgtccctgtttccctttcccacccatgggatctctctctctctccctctccctctccctctccctctccctctccctctccctctctctctctctctctctctctctctctctttctctccctctctctctctctctctctctccctctccctctctctctctctctctctctctctctctctctccccctccccttgttgctgttgctgttttaaggagggcagtattcagttaaactcttgtatggaagataggctccaaattggcagtttctctgcaggagtgtgggggttcattccttgggattttcttagtttatctgaaagaacagcaaagaccagaggaacagccagagatgtgatggggaaagtgagtgctggtctcttgtatacagcaagcagtgtggacatgtcagttacaaccctctgcctagacaaactgcctcctggggttcctaaatgtcacatcctttctctgagaatccttcccaaactgcactggggaccctcgttcctctaactcccttaggccatcttaccccgccttagtactttagattctctgttagaactgcctatgtgtttgctacatcgtcctatacttggacacagggactgtatcttgttctttttatatctccagcctacaatttggagcccagctaggcttagtgagaccttgcatcagtgagtaagtgaatggctgggagtagtgagtcttgttagatggtgggtttctgcttacctggtgtatcagctagctattgctgcataacaaatactccagtacttccttaatgtatcagctatttagtcatgcttcggcttcacagttctactgatttcagcctcatcagcttctagggcagtagagggataaagtgaactaacttggcctcaactggatggtctctcatacttttcatgtggtatgtatttttaatcttccagaaggctagcctggacttgtagatgtgtcagaagcagggtttccaaaacccaagcagaagtatgcatgcatggtctcttgtggcccaagctcacaacagtcccagtacagggacaagtggggaggctgacacagttctacaagctatcatttgggcagcttgcaagtgcacaggagcatttgagttgtttgaaaacaacaaacatcacagttagccagaaacccaaaatccctttcaaagaaggtaaacacgatgtcgttcagatcgggatgggccccgagtctctttctccagagatgaatgaagacttgtgaaaggatttttagaccaagaagagaagtaagctgatttccttaaagactctggattgtggagacaatagattccgaggttgtgtgagaccagatgggaaacccccttcagtctccaccattagaacccaactcctagcaggtgtgagggagaaactataccatctagcagattcacactaaagtgtcagtgctgctttggtgacatttgttcagagagaccatcaatgtgtcccatcagggcctgagagcactttgggcctgggggttccagggtgcccaggacaaaggggaggggagagaccatcactatcagctgcctggggacatctcaccttctgaactgggaggtcctgctggggaagggtctcatgctgtgttgttgctaaggtcccagacaggctttgggcgtggttctctcaggtggggaggctctggttccttctggggccacttgctacagcttctgcctcacccacccaatcccctgcaatggatattgctttcaaaatggggtgcctcgtgttcagagtactatctggcttcaagattctatctgtcttcggctactgggactgtcttttaagggttatttttcaagctttgctttggaagtgactgaggaatcgtttatggagacaaccaatcagtgtctacaaagctgttttcctccctgctccccaccctcaattctcagagtcacagaggcagtgtggtccttggccagcttcttcctaatgtaaaattcacagccctttctggccaacagttcattcacatagcgggctaagcatacccagacactggctggctccagaaatttcaacatccggggttccttgaaagcctgggtctgcttatcagtagtgttcaatattaggttacttgcagaatggagtcattatcttcaatgtttaataactgtgccaccaacataatataatcaaatctaagaaatgtaatttagaaaggctttggactcaagccttttatgagagtgtttttaatcttttatgatcttgtccctaaggctgagaaaaatcttgttttctctctatcttctacttgatttgtctcctttattttgctgctgattttcttggccaggtccagattgaccagtttcactggtaccaaaatgtggggagctgacatgtttgggctgaattgtaggagcgagaggtcagagtggcagctgggtgctgtggggctggagtcttgcacagtgaaggcttgttttagtaaggagaacagggacttgtgtgaactgtttgctcttgacttaaatgaacaaagactccaggatggatgttcaaccctggcagcgtccattttgtccagatggaagtcagcctgcagtaggtaactcctttgtaagggatggggagttcagggaagagcttggcagtgcagagaagcccccacctacagtttcctgcttaggaaatttcgtgtagtgcagtagtccagtccttttgatttgtattcttagaagaagcagtcagatgaataagtctttgactttttgtgatcgaactctgatttcccttgggcagaatccctttgagaaataaggcagttagaatgttttgagttcttcctttcaggaacatagaccataatggtggccctgttttgtatcctgaggggctgtggacaggaagtctacggcaaggttcataaaacacttggagttttcttggagaaaggagccatagaaatggaaggcgtttgtctgtgttagaaacctcccacagagtctccaggctctcatgtcaacccaggtcataaagggaaaagatctgttacaagtcccctcccctcccttctccccctctgtctgttactcaggggagaaccaaagcaccagggcctatccccgagactcctttcagcacacacaccatcttgcttgctctctttgaaggcacaaggtagcttccccctctgaattctgcggtgactccttcttgtgtttgatgactttatccgatgacttgcccacccacattgggagtagggagaagagacttggagagctgaagtcatgaagggttgaactttagaaagaaatgttggtagtgatgctgggtatatgtttcttagaggcatgagtttttgtgatatttttgtaagcttggtcttatttccttcaaattgtggaggaagatggacgagagtgggagcccaaagtagaatgaaaatattgaagtgtagatgtgttaaaacctttggtttagagtggaaaccacccctttccagatatcaactacaacatcatatgttctagggagatgtctatacacaccattggttttaacattttaactctgaattaattggacgcttaaaacaaatggttgattcggccagcttcttaattgagttttaacaaaaccaagccaactactgcttgaatcaactggccatttgtgtgctaaaggcccaggcaggggcaatgaagtcaaacgacttagtgataaaccttatggtcaggctgaaggaagaccttagacttctccatggctccccaaagagcgaaagaagtcactggcgtcccctccaagtctcagctcccactttcaatgatattctccatccatgttgaaaaacacatgaaagacaatgcctttggactccatagtgaccctgtagcaggggatggcggagggacccctccccccattgatgtgaacattagacatgaccctattcagtgttttgtttgtttgtttgttttattgtttgtggaaacactgtttttctgtgactttaaattgtaaaagaatattttccgtaagcatatttattcatgacgtttttgtatttcttttgtgtgtggtgtatgttttctctttctaccacgtgagtcccaggggatcaaactcaggtcatcaggcttgcggcaagatggctttacctgcagaaccgcctggccagtcatctctaagtatagtcaggaagacagtttcatctagtttgcatttgagaaactattttccatttcactatgagagtacattgactggcccggtggcctcagcaacatagaacatgttggattctcctgggatagctttgtctaagactaaacatctgggagaacttccatgatcctctgtgacgcatctatgtagccatgtctagcatgatattcacccccaggcggtgtccaagtgctcagggtctggcttttactggcctaagacatgtgcattgatttcttgggttgggctctgcttgctggtcctacctatctacagcttgggaaaagaaccttctgtgtcctggctatcagctatgtcatcatgctccccaccactccctgccctggactgggaaactgtgctaaagtccagagaagcaggggcccctggccatgtatatattatataagatgttccaggggccagggactcatatcccattcacatgcattcttcttcataaatcctgtgttaaagggttatttctacagtgaacacattttacatgtttaatgggggtgattaggtgtgtagtatgggtctgtggaggtcagaaggcaggatcaggtgtcctcctcagtcactggaaacaagagtcctcaactggactagagctcacagataaaactaggctgaccagccagcgagtctgaggctctgcctgtgccaggagtacaggtgtgtcccaccactgtgttcattggtcttttctgtggtgttgggggatccaaactaaggtcgcatgcttactcagtatgcacgttaccacactcagtatgcatgtaaccacacgagagctccccacacctctgatgttgatgcatttcattaacaacttccaaacctacaacatgacagagccttttgtacattgtcggcaggcagaccctctcaggggtgcaatgtggagtctgagtcaccagcacaagggctcgtggctggaagtgggtttgtgctctgtaatgtgtgggtcccagggattttcaatgtccctggaacatttcaacagcagaacctgtgctttctggttatgaatgccgttatgtcggggacaaagcacttgtttagcacaggcagccttgcttttcctggcctagcttccagcttccatgttgccttttttaggagcttacctaaagaagattcttgtgtagaattccatcccaaggagctcaataaagattcagcaaatattatttttatggcctgtgtgcatgtttactttatagttactctgcacatgacatgcaaatgttgtatagtggtctcatgcatgatttatcttcttagaaacttcagccatgcttggctgggcagaggtagtgcacacctttaatcctagcactcaggaggaagaggcaggcagatctctgtgaatttgagtccagcctggttttacgaagtgagttcaaggacagccaaggctacccaaagaaatcatctcacacacacacaaaacaaacaaacaaacaaacaagaaacttcagcttagcatgtattccttttatgtgtgtacaaggaagcacacacctggcttacacgattcttgatatttccatttgaaagaaaatgaaataagttcagagagacagaatgacatcatcaaagtcacaagagcagctatgaagccaagacaggatttgagttcttgccttctgacttcatgttcactcttcctttgtgttatgttatgttatgttatgttatgttatgttatgttatgttatgctatgctatgttatgataggcctggtgttgcgttaggatgacaagcacgtatcttgccagcagcatgcattattagtctttctaccgccatgcactgcctttttcgctggctgataaaataggtgttgctttcaaaaattatacccaccaagacgatagcagcagtagtaacacatcttaacatgagatcttttgaacagccatgggataatttgaattagaagaattttactcccaagttactcctttatcagacattatgaatccctgccctgtggcactgccgccccccttagtgagaatggtacagggttaagtgaggttgtggttcctgctattcctgaactcatagccccatggctgggaggtgggacagccaccactggggcggatgtgtggtgaactgggaacattagtgccaaaaacgtccatcttaacttcatttactacgtaaaaactggtctctgtaatccatcgtcaggtaaatggttaaatggcatgcactaggtacatacaaaggaccatcactcagtgtttttaattctgacacccgcggtatggatgaaccttgaagaccttggtcaaacaagccagacacaaaagagtaaacaccacatgattccacttagaagagagactcgtttgtagagctagagtctggaataggggtcctggggttgggaagtggagggtgagcggttagtgttcactgtgggacgtttcaagttgggaagacaaaaatgtttgccgtggttcttggtggtggttaaagagcattaaccatacgagcactactaaactgtgtcatccaaaatggtgatgttggcaaatgttattgtatgtatctgtctcacgtatccacattagtctatagaatagaacattgtcagctgtgcctataaaaaccgagtgcatagaaatgctcacaagcacacagtccttggaaagcagaggacagccccatggtaccgactggggttagagccagaggcagttgggactgcacaggtgtcctgtgtccttccagttgcttccttccccagtgctcgctgctcagaggagtcctggtgatggtgaataccgtccaggaccgggtgactttttcacagttgattggtagggagaatcactgttgtctcggagaaatgagaacatgcacactggaaggctgcccctgcttaacgctcctctccatccagcaggccagatggcgttttatgtggttttcacaactgtgactctggattgcttaggaaacctgtttctccccagctcctgcctcgcctgcctttgagcttagctttcatgcccgtggcaccgtgtgaatggtcacagtgtccccttcctttcccttttatttctgcagcaaagcctaccccatcatctttagccttaataactgccccacactagcataggaaagcctgtttttttttttttttttggttgttgttgttgtttttttcagggctggtcctatgagtggtgatccttatgttcagttctgatttcccccctgagttaggatcctccactcgatgccgctcaataggagcagttctgttgctacactggctttgcctcctccgtctggcatcctaccatcagatcaaactttcataaggagtcaagtcaaatttatgtgtaattcaagaagaacttcactaggaaggcagtaatgaaaagaaatatagatcaacttataaaaggattttcaaaatgctctttatataaaaaaaatcttttaggggttggaagatacttagtaaagtacttgcagggtgagcatgaagaccccagttgaattcccagcacccatgggggcagaggggaagctgggttgtgccgtgcatgcttgtaatgccattgttggagagaaaggcaggccgctggctatccagagtagccttattcatgagctccaggttcagtgagaccttgtctcaaaatataaggtggacggagattgacaaagattcctaatactgacttatgacttccacatgcatgtttacatacatggatctgaacacacacacaggcgcgcgcgctttcactttcagaaaaaaaatgttttaagaggatcttatgtattccaggctgaccttgaacttgctaggtagttgagctgaccttgaacccctcatccttctgctccaatgcctgagtgctgggatatcagtttgtgcctccattctttttatgcaatgctggggaccaaacccagggctttctacatgttggggatgaactacatcaactgagctatatccctgccctctctcagtctttgcagcagttctgtgcgggaactgaatagctatgtcatgggagaaagagaggtcagagaagttaagtgatgagggcaaggctgcctaacagacatcggataaagccagatctgaggctgtaccttctggatccacatccagaacacttattatcaccccaatatgcctctggaaaaagacagttccatctagtgaggacagtttctgcattacccatctctttgagtggcacatgaagacattgtccttccctagatacatcacagtgaccatttagactttataagactcccttatatattcgttctttagtaacaagggtctgtatgtggtcctatgtgtgtgtgtgtgtatgtgtacattcacacatatgtgggtgtgtgtgcatgtatgggggtacatgtgtacatgcgtggatatatgtgcatgtggagatcaatatcagacattattctttaggtaccatccacctcttctttttgatcttttaatttaattacttttatatgtctgagagttttacctacaagcatgtgtgtatgtatgtgcatcacatgtaagcctggtacagagcaagtaagaagagagtgtcagatccccctttgactgaagttacagatggttgtgagccaccacgtaggtgctgggaactgagcctgagccctctgcaagagcagccagtactcttatgtgctgtctggtcccccactttgtcttgttttgtttgaggaagagtctctcagcctgggactgctgattagactaggctggctggccagtgagccttcggctctgctgtttgccttctggccctggcattactagtgagaaccactgtgcgggttccccatgggtgggtctagggattgacctctggcacagaagcacttttctgtctatgctgtccatgtggtatatgtggtccattttaatgacctgacaaagtgaggcagagatgtgaggagagactgagtggatttggtcttgaagtgcttgtttatctgctgtgacccttacaactgtggtcctcactgttccagcagggatcatgggatcgtggaagacagcagatgttacgaaggacacttctgtgatggcccccagagacttgcagaagattgggtgacagtgtgttgtcctgcagtgctagacttctggcctggctcatgaatggctgtgtctacttaccttcctatttctgcagctttcctcattgttcaccaccacaggagctgctgcgtggactttggaagaccttctctttggtgcagcttcatttgctgaagacttcagacctaactttccctatttctacacccctagctttctttctttttatatttggtggtgtatgcatgcaggaatgatgaatttgtgtgctgtgtgagcatgtggtgtaagggtgtgcttatctgtgctagtgtacaggcagcggaggacactgagtgccctgctcccttctctgctctattcccttgagtcagggtctctcattgaactcgctgaagtcctaggctggtgaccagcatgccccagtgagcctcctgtctgcctgcccctcagggctggggttatagggcactaggtcatacccagtgttttctatgtgtcctggcatccaaactcagattgtcttgtttgcccagcaagaacccttacccagggaggcatctctctccagcctgttcacctacctttcaaagaggctttcctggctttcagggtcctctgccaggcatctatcagccttccattggtagagatgccccaaacctagatcatattggcctatccacagggatgactgagttgtggcctctctccatgttcctctaggctgctcgttgctgcccattctgcagtgtatgcagagtggagggtggctcccagctgctctgggtttttgcaatgatctgtcctggagccgagcttcagcatggatcattctgtttcctgtcggaatcaattttctgtccaactctcatttcctattgtgtgttcctctggggtcagcacagctttgtcagacaaaagcggggctttctctcttggagatggtcccggcttctcttcagctgtgtatttgtctaagcaacagccgggcacacagtgtgtgaccacccagctgctttggctgtccttcctggttgtgcttcagggtttaatcttcagggtttagtctttggatgtgggctggatggaatccttaccctgtatcttaacctgtaggctctcttctgccctgacagcatctgagcgttcttcagcagaggtgaaacattacatcaccgatattgtcaccattgtttactgctcagatgaatttggcagaagactcaacagtctgtgtgtgaaccacagcactgaatcagattgcagagaaattcttatctgttctctgccttccattgtctgattttttacctataaacattacaacgtaacctccacacctttccacaccactgtgctgctctgaacacagacaccaaggagagtcaccccactcattgtaacccaagtgtccttggggtccacctatgtcaacctctgaggatttcccaggataacaggaaattttattatttctttcagaacacggaggactaatgtgacaatagagatgggacacggtcattacaggatgaaaaatatgatgggataagccaggacattctgtgacctagactcatatcttctaacacgctggatgaccttgcgcaagctttactctgatagccctgaatttccttaactgcagaaactgccctgacaactcagtatatcaacttccatccacttataggatcttagcagaatttatctggatgttttgattgtttgcctctggataattcttgcttgcctacccaaagaatggccattgagtcaggtaaaggtactgggaagagggtgtggcattcagtaagatggaggcgagaagaaacttctctcacagagaaagcattaatacagtggagctactggcatttgagccatgctggaccctctgccctctttaccaagtttctaggcatttaaaattgtcacatgctcccgaagcatgacaccatagggagcatgacccggtgggggtcctcagacaggtacagtcccttcccctagcaaatatgacacttttccagtcaatggctgctagaaagttctccaactctgctgcctcccacttcacatgaggatccccgaggggtggggaagctagcagggccacacggtcacctttcagggagcacaaacaaggagtctttcgttctagggatgaaggaaccacgcaggggcgttgcatgttttcctgatgctgtaattccatctctggtgcagtgctgacatattctagttcaaagcagctaagggaggaaggggttccgattccaagctagagctcatcactgaggggaagttgaggcagggactcaggcagccggccggtcacagcacctccacagtcaagagcagagagaaacaaggtgtagaagttaggtcctggttcttcttcccagccccatgctcccagaactaagactcagattcaaaataagtttacaaataccttggctatataactgggctcttctatgactagatcaaaatgtattgtaacccatttattctaatctaggttctaccatgtcgccggttacctgtgtctctcgccacatcctcccaggagaatctcctgcacctggctctagcctagaatcctttctgcctcccggatgtcccacctcctattctaccctttcctataggctataggtatttttagttgacaggcaatgcatccatacaatacacaagataattctttcctatacaacacatccatgttccctacctgctcattagactcagctaacatccttcattcttaaaccgttcaggaccagcccatgaaactctgctacctgtattcaggaaagtagggtggtttcccacctcaattaacaatagagacatttcccccaaagtattcctacaggcctacctgatctagataatttctcaggggagactctcttgtgtaaagttggtagttaaaacaaaacccagcacaactgctctttgagtgagcataccagctaacgagtctgatgtgatttcagtttcataagagtaaagtgttcacacgcttccactggagggctctgaccacagaggccggaaacacccaagggcacccctctcctctccagccagcccagtgctcaacgagaccagagaagggcttgatggccattggcagaaatttctgtaaatttcctttatgtgtggattggaagatgatatttttattcaggaaggcatgtctgacccaatgatagaaaatggaattgatgccattttttagattcaaccctgtctctaatgtctattcttctgtttggttctgggcaccccttagctccctgctttttcaagaactttgcttagcctgactcttcagaagctcacagacaagtaaagcctaaataagacccaggtatccctgaaaggcacttattgtgggcctagctctccatccactgtccagttttctttttcagtttttcgtgtttgtgtgtgtgtgtgtctgtctgtctgtctgagtgatggcatgtatgcatgtttgtgcactacacacacacacacacacacacacacacacacacacacacacaggtgtacatgtatgtgagtgtgtgaatagttctgaggtttctatctggaatcttgctcatttgctttacaccttattcattgagtcagggtctctccatggaacccagagttttctgacatggctagtcttgcttgctagcttgctctagggatcccctgtctcagcctgctgttaggattaaaggtaggctgccacacccacccagcatttatgtgggttctggggattccaaactcatcctcaagattgctgtgtgcacagaaaacgtttgcactgccccgctccccacctcagtgtctaacattttgaaagtaaaatcacatttgccacacccgctcttatcatgagcagttgcttgaggctgccttgcccaaggtggctgacaacttactggttatcaagcgaaccacaagttaataagctcttttgtgagacttcaggagtgtttaaaaaccaaaccaaaccaaaccaaacaaacaaacaacacatcttagtactgtgggttctatttctactctgtgaagacttctttctttggctgtccttcatagtgtcatggtgaaacggtacagtcgtgtgtgcacttagaactgctctcatggataccctatgaattataaatgctaactgctgctgtttcctgggacagggtgttttctttctcatgtttactcccctgtcctctttcctgttggttttattctttcctttccttaaacacagacatctctcacgcttctctttcatcttcctctactcttaaattgcgcctgctgtggcttagctggtcagcagatctatagacgcggcttctgagcctctctccagcatgggagcacaggagcatgggagcacgggagcacaggccactgccagggcatgggggacatttgctttaagttcacacgtctatacctttcctccgagttacaaagaagaattgtacaattgcccttggttttacaccctgcttctctttcctcctcccccctgcctcctgtcaggtggctttggagtgattatgagcatttttgacttcctattaagtagaagttctgggttgaggagcatatagcttcctttcatggagtgcatacatgtagatctcagctgttcctgtggcttaaatgctcctcaggccctgtgcagaatggcctcctcctgattactaagccagctcctccagaagggtggcaggcatctcactacattacaaacatgtccccaatggaaagctaacccagaagtctatccactgttgagtagttgaacaaaatgtggcacgcattggaatattattggcaataaaaggaaattaagtatgcattcattcataaaatgtgtgctaagcgtgggaagccaggcacaaaggagtggacttatgattccagttgtatagaatctagaggtggcccatctatagctgctaagtagattggtagtcaagaggcaggtttgggaacagcggactcacggatctggagttatttgtagggaaaatgtagtgctttattgacgatggtgtgcagccctataaatatactcaaaagtataaaattatacaagttaggtggctaacttgtactgatgtaaattccatctcaattaaggttttacagtgtggaatagagtgagtctgcactctaaaattctacttgttgcctctggaatacaagacaaagagccccactgtctcttcccatgtcttccgtgggtcttcgtcaaccttgtgcatcacttggatgtcacatcttgatgccacgggttcatcttctccctccagacaggagctgcccttgcatggactgcagtgtggtgtctttatctctgtttttattgtttcttttcctctgtgtgggattgaggtcacgtcaaggcaaggaagcatgcatggctgtgtgagcatcccacatgagcacctggcctagcctacctcatgaggacacaataagtttctgtcacctgacaggacggctggactggattgaatttgggatgatccgaagcaccacactaccttttacctgcctccttcactggggtcatcagaaagcaattaaggagcaatgtataaagacatttcttttaaactcttgaaaccgcacagggtattatcatttgtaaccgtggaaactattcaaattagtgtcaattaactcctggcagcacccttcagattccttatctttgacattagtttgtcaggatgaggtaatgtgctttttctaggcaccgttgcctttgaagagattggcggtgtttcctggttgtaaacaaaactgtcgtacatgggcccatgacagagggatgaggaggccagaagtctgtgcaaacacttgaacccctgtcagccatgaggagctgcgatctggccaggaaattagcttcccactctgcgcccctgcagctctgccagtgaacagggccagagaagccgagacacgggtgttgggcccctgaaatctaatttggttcaggacaaagttgatcttctctagaaatctttgcttcaagatgaattttttttctttaattacaaaaatatgtgagatttttacatatgagtactgtattgttctcctgccctccctccaattactcctgtgtttccaactctgttcaatttcatggctcccattctttaatgttgttttatctgtatgtgtatatatttatacatgcagcctgctgaagtcatttagtgctgttcatatgtgttcagatatggcctcttagcatctgctgaccatccaccagggtgctcatccccaggacagcctggttcttcctctctcagccatcattactttcctccttctaggaataaaggcgtgtgagaatcctcccatccactctggcttgccagttgctgtgtccttgccagttgctgtgtccttgctaacgttttgttttggcgaacatctgcggagattccctaggtgaagcttccacgttgtacgtaaaagacctcgtcttgcagccgatgtccatcttggtcctctcgctctcagtctttctgcctgcattctgcatgttccgtgagtcccgggtgtagggctcatgctatagatgtgtcagttggggctgggcaccccatggtcaggtgttctctctattttgactggctgtgactttctgtaatgttctcttgttcactgctgctcgtactggagaactagaaaagccgcactcatctttgggaataaggataagtctttagaatgcagttagaaattatcctggtctcgggaggtggcagtagtaggttctcttgaattctttaagtaagcatattaataagattaaaaatatttagccatacggaaatgtagggaatgatgtaaacaccacacccacttcccacatcaaacaaatgctgcctttccccaactgttttggactcccttccttccttctttccttccttcctccctccctccctccctccctccctccctccctccctcccttctctccatctaaacatcccaaaagcagggtattgaaccacctccttcctctagacccaccctatgtctcacccctgcttctgttaacttcttccagacatctctatctgcttagtctgtgagctgagctctgaggcaggcgctgacacgggtctgagtgtgggctgctcttcagaacctcccatctgacttgcctgtgttgttcagggtctaccccgaagcccatagcacagaagtctccacctagtctacttagatcaacccctgggctagggaagtgatgtagacttggtagattgcttgtccccaaattcctggcattctgggaaggaagaaggctctgtggtctccttgaaatatatggaatgtatttccatatggaaatttgaaattccaatatggaaagttccaatatagaatcttgaccaacacagtggtcaaatgttttatttacaaataaacttacctcatcaaaatgtaaacctgtgtgtgtatgtgtgtgcatgtgcacatatatgtataaatgtccaaaaaggccaggagagggtgttggattccttggagctagattataggaggttgtaagacactgcgtttgggtgttaggaacggaactccaattctctgctgtaagacagtgtgtactctgacctgctgggccatctctcccattcaaacacctccttctccttacctgtgtaatctggcctattagttttggttttcaggagaactctaacacaaaaacactatttgggttcgaagactttctaatcgttgcctttgagagatgggaggcattggtaggactcttaacccattagccttaagtaatcctaatgtatcaatgagcgatgggaggcgttggtaggactcttaacccattagccttaagtaatcctaatatatcaatggtcatattcactttacacatagtagttcacttaaaccttataacgatattctaagggaagttagtggccagcattgtttaaggtctcatagttagaaaatgatgtaatgttttcaagacccagatctgaataaagcaggccatcctctgagtcttattgtgaagaaatagggcagggatccatctcgggagataatccagacgtagctttcttttgtaccaaagacttctctctctttctctctgattaggtggggggaggggtgtatggggagcctgacagacatgtgtgaggcagaggctgtttatatatcacatgcagtctgtggctgacccaaagagatggggagcaagctcacaggaaagagactatctgcaggagcctctgagatgtgtgggaatccatgcccgggggaaactgcccgcggcgcggctgcaaatgaactgttcatttcccacagcctcttgcaatttaccagtcattctcccagcgtcacgcaaagctgcgaggatcagaacaggaaggactgaagccccggttgtttgacgctcctccggctttcctcacggcacctgcgtttctcaccagttccatatgcacctcaggaatttctgctgtgcggttgtctaaataccagcatgcagccagaaagggagaggagagctggggtcctgaggcatgcaggcattctcagagagcacatgggaagccaagagctagactggctttgcagccacgtgtagcttttcttaccaccaccccaccttttctatatgtaccccacttccctcagtccagcctcagctcagcaggtgcttgcgtgacgtggagtggccctcagagggtctggaggttctcatgatgagaatgcaaaaatgtgtgcttactaaagccatgggtgctgtttaggctggtgccccttgtggcatcctcccctcccccttaaccatttcccaaacaactctttgtgggtgcccatctcgcctgctatattggagaatcaccctaacgcagaatcaaccaagctggattgacattgagttacagatagattacatttggattgaaagtctcctagggaggttataatttggtccacctccatagagcctagtatctgatgaatagcaggccggcctgagggcaggacggggctatggggaagagtaggcgctggaaccttagaatccatccaaccactccctgggctgttgcttcctgccaggtaagtattgcttaggtacccagtctaggattaaagcgacaagacagaactcgtaccaaggatgcaactgatggcccatgtcagctggttggagttaaaaaatatattttaatttgcttagctctctggggaaattatctgaacctgcatgtgctaatcaactttcacaggcgctttcaaggaacccaaaacgagtcaagcaacaaaatgagatttttaatctacataaatacagaaatcttttgccccccccctttaagaaggagattaaaaaaaattctaattcattcttccctcctgtctccaggactctgccattagcagctattggaaaatgatcatagctttcaaatctttcacaggttcccccctttttgtgtaattttctatcagaaggtcgggggctgtggcaaatatcacacacacacacacacacacacacacacacacagagagagagagagagagagagagagagagagagagagagagagagagggagagagaccctttagaggagaaagcaggtcttgcaggattgatggatttgttcaagttccagtgcctgaggggttgcagtcaccactaggacccactgtctacccttcgctgcctcagtgatagtagggtggtcagcattaacataggatccataaggagtgaagttcaaggtcagatagatttttgttgccacctctccattcagccaggataagccaggttcaattatggcaggtcgtttatgccaggtccgcaggggtccccgtgtatgcaaggcaagtgctctagctttggtgcatgtgtgtatgaatgcattacatgtgttcacgtgtacatgcacatgggaatggagtccagatgtcactatggtcagttggtttccttgatcattatctttttttgtgtgtgtgagacagggtttttcactaaaccagaaactcatgtgactttggctcgacagctggctggcaagctctgggaacttcctattcccttccgtgcccccacctgggattacagacgtgccctggcttttgtctgcgtgactactgagaatccatgctcaggtccacgtgctggttcagcagatatgtgactgagccgtcttcccagaacgcccccctttttggttagcaaaggatgaagttatagttgtaacatacatagatgagtgtaggattgaacatagttcctgaagggcttttgcttttcttagcaaataaaatcagacacatgaagcatgggacacaatagttaaatgttcttatcaatgaaaattgaaacaagtattctaactgctaggatagaaaaatagaagatagtttaactggttttagtaacacaacatacagtccatatatttggtaaagtcattatataagtatataaatgaattatactgcctttaaaacgtatattaagatacttacctggcaggggagataccatgatcacgaaggtggttttcccagggtgaggctcacccattgcacttgggatgtgctgacccctgcaatttccccaaacgcgggggaaactcgattgcataatttgtggtaatgggggagctgcgtttgcgcgctccccttgggaaaaaaagtatattaagggggttggagagatggctcagccgttaggaacactgactgttcttccataggtcctgggttcaagtcccagcaaccacatggtaacttataaccacctgtaaagtgatcagatgccctcttctggtgtgtctgaggacagctacaatgtacttatatacataaaataaataaataacttaaaaaaaagtatattaagatgaacaagacacgaaaatagacaagttcccaatgacgacatgagaaaggaaatgtttttttcccatgtcgtttgataaaggaaagttaccgttttaggcactactcatgtttattaaggcaactttaaggactgaggaatgtgaactctgggctggggctgtaagctcagtggataacagacgtttgtaaggcttggtctactcttatcaaccactggatgcttgtcacagaagctatgataacgtaccccatccctcgctatctgccttactctttggggtaaggaagatgaaccagtggaagctcttacctgtaaggtgtttattttcttcccccaaatttatttttattaaacttatttgtttatctcctttacaaccagctcttcttttcctcccagtccccctcatgcaagtcctcctccatccccctttcctcttctcttttgagaaggtgaacccccctctgggtgccaaacgtcctcccccacctcctcgtaagatctggacctcctattgcctgggaacacctggctaaggtttgtttagttgatgactgttgggacaaatggaccagtggggctgagaaaacttcgtgctgggccagagtgagatgacaagtctctcttctgtcctggctgagctgtacactttgaataaaattcttatttctgagcttggttcacaggtctgctctcagtatcagtgctgacctgggcagtgccctggtcaactgtcttatgtcccgatagccttccagaagtgggagaaatatcttctattttagcattgagtagttttccatctctctctcaaggtttgaacttattttccagtacatagtgaatgatgaaatgccaggagagtcctggattatgtgtcagttgtcctcagtagctattatctaatgggtggatggttctagtgtaagatgactgtctcatcgttggatggtgatgatggatagacaatatggaaatgcatgaggtaccattgaaatgcatacttaaaaatagcccaaatggccagttctgtgtatgttttaccacaataaaaatagattttcactaaaaaaaaaaaaaaaaaaaagtatactattaactcccaaaatgtaaacagaatcctagctgaattaagctctcaaaatatgtccatcacctcccgggcctagtctgctccaggccaccagactaggacagcttctcggttgctgcttctgatacgatactcaagtgtggaccaaagcgtaatttgcaagggtgttgacaaaccaaaaacagtttgactactcctaccacctcttcaaggaaaccaggaggtctgtgttttccatttccttgtgtgtttcccttaagagccctggctggggctcatcgtccagtgatggatgcctccagtcaggagcacatattggagctgttgtggtgatctacgactcctacgtttcagggctgatttggattttctgtcctccccagccaggattctgctgctctgttggtttgtgccttgctgttcaacaggagaaaaatgaacccagaaacaagctcagaagcgcacacgtggtgctcaactctgcattattaaaaggcccaaagagccaggccttaattttctcctctgtaatatggagagctgagcagaggagcccgcctgccatagattcagagatgctatctaacaaatggcagtcttaacgggatctgagatcccttacatttttcccacctgacaagcccagagggctcattgtctgtggcttttctccgggctgctgctatcccccagggctgattgatctgtttattcttagcttgaggccggagctggaagggaggcagtttgttttgggcactgctgagaaaaacagactaatcacctaaatagcacctgggggagtgaggtggctctagatagaacagaaagaggcaggcgctctttaggggtgtgtggaggaaggaggagctggaagtggtagggagaaacctggaaaggtggtacagccagtagccagatgccagccgggccagcaaaggaatttggtgtcttcacttgtccagaggaagacctcatcatatctgttctccacatagctcctggcctctggtgcccactggtgctctggacagggccctatgagaaggctcaggtcttagctttcttgagttacctctgaaacttctaagcaagtgtctctcccattgtagagtcacactccgcttgctttccaggtcgggcctgcatcagacctgtctctagaggtatctttacttacaaatgcagtgggacaaattctttgtttctgccagctcagattggtctctgtctccaggattaagaactcaggcgcaggtctgagagatccctgggtattaagatttaactctgggccagatcagcaaatatttattgagtacacacaaaagacaggacacaaatcattaatcaacgcccgctcttgtcattggctgggggaaaggcaatataatgaatggctggcaaatacaggtgtgaattccacttagcctccccaaggcaggggacagaaaaattctggaatggtagagtccagtcgatactaatgggattatccttcagggagcttgaccaaccaactcaaggtatttccagtgattcttcacctccaagcagtgaagagtctggcagagttctgagcccccccccttttttttcctccataacatctgcaggtggtagaccagggctgcagttatcccagagctgagggatgagattttccagctctggtcctgtgtggaggcagcagggaggttcctgcaactcctcagggtcataaggccaagtcggaaaagcagcaagatgagctcgggagtctctggcatatgcattagcgtcccagggtaaaaactgtgtaaacggtacatgacttaattcctctgcctgttgggtgtctgtcatccttgagatttcccggggccagaagaggtcaacacgagctagtgtgacaacacctagctaagcaagggaaaagaatttctcagtgatgagggtcagcctgaaccaaggctgaccagaaaaacaagaggattcagttttaccccaagaaggagggagaagctttgtaagcggaaagaaaagaggactgtcttggccatggctctcttgggactatgtaggaactgttgtctttcttccctgttagttagcagctttggcttagtgggaaaatctaagattctcaaagcatcatgcagtgggggaaagggtttgggatttgacaggctggggagagacgtggtataaaatgtaatgcacggactctttaaggtggagaacagaactgggcagtggtggcacacacctttaaacccagcacttgggaggcagaggcaggcggatttctgagttcaaggccagccaggactacagagtggtctacagagtgagttccaggacagccaggactacacagagaaaccctgtctcgaaaaaaaacaaaacaaaacaaaacaaaacaaaacagatggagaacacattctgaggcaccaggaggttcggggagaaaatgaagctttgcccttgcaaagtcagaaggcaacagatcctgctcacttcctcagagagaagttatgtgctaaggtccagagaggtcggatggcaggaaattgaaagctgtgatgttgacactctagatcaagtgtcctttcatgatcttagacttttgtgactgaaaaaactgctctcctaccaaggaggtggactcagggctgaagcgcagtacagccatgagcatttccccttggaatctaatccagccaggtcatcatgaccccctgcatcatcaacagaagtggaacactggccaaacatcaccaaagctttagaataacatccacttacttccaggcctcccgagacccgattcctcgttcattcatctactggactttccaacttccagactttccacagctgtcaccgtttagcatgagtaacagcctgcagaagagtgtgggtgacagtacggcatgctgccgggcgacatcttgctcagcattgcttatgcaatctcctgccactggccatgtgccaggcctgacaaatagccatgaaggtgacttgtcacaaagtaaatatttttgtgtaaaaagatcactgttgagtttactccattattacatattctatgcttggcaaaataattattacagtaaatgtttctgcttctgcttttgcttcttcctccttcttctcctcctcttcctcttccttttcctcctcctccttctcctcctcttcctcttcttcatactcaaaagaaaatcttggtggaatattttcctgtccctggattattcggagtatccagtgctgtctgagttctgtctcatgcatctcccagcatctctatctttcttgggaaaatgtatctacaaggagtgaaccttactgagaaaggcaaaccattttctgtggttttgtttgtttgtgtgagtgcttatagatacagtgctgggccttttctacagaggggcaggagaaggacaccttgtcactgaacgtgcagcccatggcctccagcatctgtatttgccagtgttttgaggattagactcatgagcctgtggtgctctcctgtggtgctttcccgtggtgctttcctgtggtagcttaggtgtggctccctcaaggggcattgctttcagagcctggtttcattcaaaactcaaaatgaaactcaaaatttctctttctcctcacttcccccttatcaacatcttgtatttgtgtggtgcatttgttatgactggtaaaagccaccatcaatacattagtattaactgaagctcatagctgacattagtgcttatgccctgtgttgtaaagtctgtgggttggacatatgtatagtgtcatgtagcaatactcatgtattgagtactgaaccctaccatgctctgccactgggtatatgtatgtgtcctacaaaggaatttcattattccccaaatcccattcagtcaatttcaacttcaagtttagcttcatggcatctgacaccaggctccggactctgtgggcacctatatgcacatgtacatacgttcacatgcacatacatacatgctcataataaaataaacctttaaaaataattttcagttagagtgtagtagcacatgtggtactcttttgtaatgtgtggttatcaaaagtgaatcttacctatcgagattgaggaaagatcttgcccaagctatgagcagaaggtaacagtggcatcttccttgttcccatgggagacccaccaactctagccatgatggcccatcttccaagagtaagatgggaaaagccaacgggagacggatcagcacaccatccttgtgtgtgtttgaaggagcttaggctagattggtgggtggaagaagtgattttacagtcagcaagcgagtggtcaggagacaaagaatgcatgcagcacctgacgtgacatgtgcagatgcacacttcctcagcatatttagttagtatattttctgttcttagactggtagatgcttataatgattagaatctcccaaggtgacaaaagtgatcattagcatttaaaacatttgtagtttttaactagagccaagaactatgttcaggaaatgacccaggatcagagagctaagaacccactggtagctgatgctctcttgctatgtatcgactatggctgaagaatcatttcattggcacctctgattacaccatgtgtcagcatggggaatgtttgcacagcttcctgtgtgtcagtcaggcaaagagtgtgtgtgatacgggctgtggttcaggtttatggcccagcatggctgccataggcttgagcagtttggaggcctgggcctctgctgtccatctctctttttcatagttaaccagagacaaaaacaaaggtttaaaataatgtaacagtgttgcaagcaggattccatgctttgctaggctggagcacaaaccacctctccccctttagaaacataaactattgcaaaaaaagatgagaaaggccaggtgagatcttgtgagtgtgatttccctgggaaggaggcatacgtatttagctggcttgcagtaaatctaactgatgttttccaaaggtaaactgaaagccatcaagtagtagagtttatctctcgacttcatttttattgccacaactccgttctgtttagaaagcaaacaagccgttagaatattccaacagaaatgtcgccaacatgatttagtaggtgggttatttagtgttcattagcagagtcccagctttggtggacagtggtgaatttgttttgcctctttcaagtccagtgaaatggcctttatttttttcccacccaggtagtcaccctgtctcagtaggaagattcaaattccaacggctcttaggtttattccagagctgtcaaacacaggttctgagccgttctctttttcagttttgggggccctgcagtgcttggaagtgttgacttttagggagaggccaagaaaagcctcagtgtgtgccaagacgttagctgtgggcttggcaccaggaaggtcagctggtggggatggggtcagttggcttccagggtacacttcccacagaggcgattcaggagggctgtgtggtgtgtatggacttggtgggtcttactgtatctccagaataacattcaggatttgacaaatctatccatttgtctgtagtctcaaaaaatatcctcgaactggaaggcgactttgaaatcatccttagccaatttcagtctgatttctctctttgcagatccagaacacgcctcaagaggccctgtgactttcagggtccttgcctcaccccctggtcaccctcagtctttgtttcttctccagcctcttctggtgtctctctcctttctctcctcattggttacactctgaagggaaagcacatggatgttgagaccagccacagaagcaaatttcgtgagctctgaagccttagataacaggagctgggagggtgagtgcttttccaagaagcaggctgcgggatgctatgcccatattgctggattccccactccaggcactgggccagcccaggcaaaccaggggtctgcagcttccgtgaccctttcggtgattctgtctctggttaggactcattatatttcttccttcattcccacctttccccattagtttccttattaaacacacttgagcatttgaatctgaaaccttcttggaagcaagccttcatcgttccatttggttatcacattggctgccttacttgtgtttcctgtctcacctgttttcctcccttgggtgttttgttgttgttattgttggtttttgtttgtttgtttggtctgtcctcatctcccaacttctagagccatctctggaaatcatcacttggcagagggcagaggaagggagcctgactctcagtgctgtgtgccaagaaaggatcttcttcccattatggcaacaattcccgtgcatcagacatctcttagacttcagtgtgtcggcttcaccgggacctcagggggctctggggtctggaagaatcaagagccactgtcttgcaacactgatcatgaaggagcctagccactgacatcttccacaacaactgcagagcacaagcatgctttaggccattttttctaattaaatgtcttcttgcaccttaggaccttagaacaatgcaaaacaaaatgagcatgcacactttctcaaggacaatactttctgtggcaacacgggtcttatcagacatcaagagcatgtgacgcctagcaagcagtagtggtctatcctgggactgaagggatatctttatcttagacatgccgaagagcacttgaggggagagtgccagggaggagactatctggaccttgtcagagcctgtcaggagggtgacagatgagagctgcaggggtctcctgtgagaaaccctgatgacagagctatgtttagctaaagatgctgaaggggaggggtctcgcttggggggctggggaccttagctggtcactcttttgtcatttggtgcatggcataatgggagagtcagttactcctttggccatcagactcagcaactgtaaactgtcagtggttctgccagaaatccgttcagagggttcctgcaagctcccagtgtcctttgcagagttcagtctgtttctctggtgatttttgttgtctgctttcagtgctacaggtcaagcctgggggcccagacatgatgggcaagtctaacccctcattccttgttgtgttatatgcctgtgtagtggtgtggatgtatacaagtgtgtgtatgcctgtatgaagaagctagagtgtgcatctctgttgctcccctctttattctttcgacagggtctctcactgaacccggaagtttcagctttctatctaagctgagtgtccagtgagcctcggtgattctcctgtctctgctccttgcccctccgagatggggttataggtgccaacagccacattcagtttttgtgtgttctgggaatccaaacccaggtcctcatggttgcacgataggcaccattaccacccactgagacatccctttcttctatttatttttgtttctgaacatgcacctctagcaggggtcaaggtctggagaggttacagttgcatttataatgggttagactttctttgtcattagttacctggacacctgtgtgtgagatggctctaatgcctacatctgctgtcagcaatgtctgcccgaattcatgctctgcctgtggtgtgactctgacattaacttgcatggccagatgattggcgactgctgcctgacaggaggctcctcctagcagagaccgtggatgtggtgcccgccatcactgctagagggcacatcactcattgactgccacgtctggtctctacctgagcagagcatggatgacaaggatgggcgctgggtttagacaagtacagttgtctctcgctggaagttgtaaagaagggtgagagatgcctaggcttaactgaggatactggtgatcgtggtgggacctgtgtctcccctgcaacgggtgtggatgtacattctgagcggaagtgtgcatgcttaataatataacctactagagagcaatttccactgattccctgtcattttgtagttctgtgcaaaaggcattgaattgtggattaaaacgggggtgcgtggccatcactgaacacaccagctgaatgcactggctctgggaatatcattagctctaccatttctgcttttccggaggctagagagggatggcgggtatccagagagaatgctcttgatggtgtgttccttggtggcaattggggttttccctactggcttcatctcaggcttgggcttcattctattttcaggcttcagggaagctgctgcttttcagggctgtcaacctgccacctgtcagtaacaccgtcagaaagatatggcagcattagtgcatggaagagagggacacaggcgatttgcatactcttttcctgcctacagccctctatctctccacttattcagctctcttcctgtgcaatttgaaatgctcagacaaagcactggaatgacctgaactgggagagaggctggaaccctggtgagatcacctctgtggtaggaaacagtccaattccttcctttcttcctttccagtgggtgaggtgggagcccagatagcagcaaccctctggagtgcattcagttaccattcagtccctctcttgctgcaagccctgtccaggctcccagctccttctcatttgtacatgacatgttcatcagacgatatcacagtaagcatgaattggctagttatgcacacgatcagtaagaccaaagaggaggttactatgactgcttctgtcagttttcatagtgaaggcctctctaaggaacctgaggctccatgtagaattgtccccttttggagcacagccctcttccttcccagggctgtgcacaggagggtaaggagatgtggaggggaccatcttttcatgagcaggacccctcaggaggagtggttgataggtaacagaatatcttcgtgtgaatcctcttccaatgattctaggcagacttcactgggccagcgagctggccagaggcccccagcaggcagccacatagtacctgacgatgggcagtagtgatggctgcagggcagtgttggaaagaaagtccatgttggatgaggttgtatttactcactggttccctcaatgatttcaaactgtgttagcaagaaagacatgatcaccaaggactctggaggaaccccagagaaccagatgggacagagaggaaagagggtgaagggatttcagggtcaagggtaaccctgatcttgatatgctggtattcagcaggacacctcagagctctactgaagagacgccagggtgatacctgcttgtcatatgctggcaagtggaagggccaacacaggtagggtgacagagtagaacccgttactctgaaacccacacttttcctttttgtgtggagaagaaagaagagcccggaacttgttttcatggtgaagtgcagagcatatgtatgtctcgagtccactttcagcaagatgcaaatacatacactagtgacactcactatgttcagtcattgaaggcccgaagataagtgatggggagggtgtcacaagccagcttttagaataagcagaaacaagctgagtattatagcgcccctcaaacccgttctcagtatggaaacttaaagactgaaactccaagaactgccgaagaaaaacacccaggagtcaagactatggaagaaagcacgggcttgttagcattctcttgcagtgatgatacctaaggcaaacaattgaaaggtttggttttgctcatagtctctggtttcaatccatggctacctggtcccattgctttgggcttgtgatgtcatggtgagagcctttggcaggagaagcctgctcacctcaaggttcctaggagcaaagagagaggaggggaccgagtctcagtgtcctctgcagaggcatatacccagtgagctttcgtccatgaatccttatctaataaaggttctgccatctccagtaatgtcgagctgggaccaagcctttatcacaagggcccttgggggacattcagctataaaacataacaattatgagatttggttaagaaaaattgagggattcacagttacacattgaatccaccaaggcagacaactgtgacaagagggtttccagaaagcctcaggttgtcttcttgactgacaactacaaaggaagggttatttttttcccctcatggaacactcagtggttgactgtaagtttttatgtcaacaaaaccatagctgtggataatagagaggtaggcacccactgtgtagtaatcactgcatattattgatatgcaatgggaggtaatgaaataataatgaaacttcagaaaatgtgctgaagtttatgctttgagtgtgtgtgatgccaggataagccagggctgcactcattaaaggcaggagcataacaaacaaacaaacaaacaaacaaacaaacaaatgctgaagccagagatgattccctggtaaaacacttatttagcaagacctcagtcgggactcccagtactcacatcaaagccagatgtagtggtgtgtacacgcagcctcagcactggagaggcagagacaggaagactctggtagcttgctgctcagcttctctactcaaaatgctgagctccaggttccgtgagagaccctgtttcaccatgtaaggttgaattgataagatggctcagaagggaagggcactcactgccaaacccgacgaccggagttcagtggacacaacgtatatggtagacagaaagaaccagttcctgcaagccatccctctgatctccacacttgtgctgtgggacaacactgctcacccagtaagtacataaatgtagtaagaaactttttaaaagtcaggcgagagcattacaggaaggtggcttctattgatttctctggcctctacacgtgcattcatcacacatgctggcacacgagtaaaagtgtgcctgtacacacatgcacatggatgcacttgccacacacatgcacatacactgaaaaggagatgcaaggggtttggaagtcagatttttgtgtttggactgtagtgcacttacccagtggcgtgtgtgtgtgtgtgtgtgttgtgtgtgtgtgtgtggtaagattcacaaggtaaaggagagaaccaacttaggaaagttgtcctttaaccactacaccggtgctatagcatacaccatatcaatcaaccaatcaatcaaaatgtaatcaaagctttttttttgatttttaaaaacaattttattttatttttaattatgtacatgtgtgcatgtgtctgtctgtacttatatataccatatacatgcagatgcctttagagaccaaccagagagtacaccagatcccctggagctggaattaaaggcaatggtgaataactgtcatgcatgctggaattcaagtcctctggaagagcaacaagactcttaactactgtgccatttctcagcccctctaactagctcttattaatctataaataataatgtatttttttcatatttcttattctatcactttgaggaaatgttattctatgtaatcttttttttttaaattaggtattttcctcctttacattttcaatgctatcccaaaggtcccccatacccacccccccaatcccctacccacccactccccctttttggccctggcgttcccctgtactggggcatataaagtttgcaagtccaatgggcctctctttgcagtgatgaccgactaggccatcttttgatacatatgcagctaaagacaagagctcccgggtactggttagttcatattgttgttccacctatagggttgcagttccctttagctccttgggtaatttctctagctcctccattagtaatcaaagcttttaaagtgacctaaccctctcccgtctctcaaggttcagatgggcagtgggctggaatggggattctctttgtgaatgctcactcctcaaatcaagacagcaattgaaatgctattatattttttgtttggcctcaaaggtcatacataggtgagcacttcctttttattttgcctaaattctgtactgaaggagcctctgcctactctaattgtccttcacctggtcagcttccaccccctgtctttctcttatctttctcgccacacacctattctggaccccgcagctgtgcattgtcctgacagtttcagtccctctagaagttgtactggtaacctgtgctccctagtgagtgctcctgctcacatacagcgaggggggctggctagtttgttggctcctcatgggaacttgcttttattcatggtccatcactttcatattctgtttgtatcgcattaaggctgctctgcacaggttctggctttgctggtccatggcaggactagaggcgagcctgtggggaagtgagcttctcagcggagaatcctggagactctgagtgcatctggcattggtctatccaaaccaaagtcaatggagtcggagtaaaggtagggtagtgtgccaatgtaaaacttcctgggaaccgaaaggtgtactgggcagcaaagatcagaccttggtgagaactaagaagacagcacgcaggtgaaaagcaagaagcaacacaatgcctgaactattgtagcacaggagctcccaacagacactggcgaccccttgttcaaatcagcactgtttgtcaggcgaagaggaaacaaccaagtgtccatcagaggactcacccaaggaaggcatggaatcctacatgccacagcatgcagttcaaagacattgacctgggtataataacccgaacccagacagtatgaacacagtggtccttctctcagggagttctttgctgacacaaagtagcatggtggttattgtgagtcaggggaagagaagagggaagagccattgtttaatgaatccaggggtcgagtttgggataaaggtggatggcgttgacggatgtacaacaacataaacatgcttaacaccactgaatggcagttgaaaatgatcaaaatgtaaaactctgtgttttttatgttttaacgacccagatggttgggactccctatagtttgccatctaacatctaactaatccagatcttttattacccctataaatatataggggtgaggggcttatttaggacttattagggagtagaaaagtgcagaggtcttctgttacccgtagtaaggcacagaaatcgtgtgtgtgtgtgtgtgtgtgtgtgtgtgtgtgtgtgtgtgtgtgcttgcatgtatacaggtgtatgcatgtatatgtgcacatgagtgtgtgtatgcatgtgtgcatgcatatgtgtgtgcatgtgcttatgcatgtatgatgtgtatgtgtgtgtgcatgtgtgtatatgtgtgtgtgtgcacatgtgtgcatgtgtctgtggtgaatagcttgtttttcctttgcagagggagtggagcgaactccacagagcatcttgtactctgtcaaagcagttctcacatccacagacgtgtccccagccatcctcactctcactgattcaacttgtgctttgctcactcctcagacccaggaaggctcttagctgttattccctggtggaacggaggctgttcagtccttgtatcctggctgattagtggcagggtaactgcccttcatttctttgtcttcaaaacattgccacctgggtctttactgccctcagagcagatgtcttgtgcagagtcaaattcctccagttagtccttctgtgtgcaataacatggaggtgagaagccttagggtgcacagaaagggcagccttgcaggcatctgcccaacagtggcttccatatgcagttaggcctgggatctctgagggaatggtgcacagcaaggaccatgttccagaaaggactatggatgccaggcaagtacagggccagaaaatagggagaaaggggtaatgggcttacaaaagaggggaatccctttcctgtacagaagctgacactcctggcggacagtagagaaatagactgacttaatgaactttagatctacttgaactggagttcaggctgaagacctcatgtcccaggccaaactcaccgttctgtgtttggaatctatagattttggcagctttgagaaaggatgactagctatgaaggccatgagctaacagcacagaccaaggaggcaaatgcagaaaggcctgtccagaatctgctgggtccttttgctaaagcatttcttttcatcccacacgtggggcaggaaccccctagaacaagggaattagaacctacagtaaaataaaataggccaaaggggcttctctgtgtacacagaggcaagataggggtgtgtgtgtgtgtgagggattatgatagtatttttagggttatagctggcttagtgggaaggggcttagctttttaagacccacatcgtccactctggaagagacagagagagacagagagacgggaggaagttcagagagaaactacttcagaggccttatgttttctgatccccagtgccagttttagtcacactaaaggcaatgttttctgagcatctgctgtgagtctggctttgccaagtcacactgcaaagatgatgttgccaccatcccatttgtgtagatgaggaaggctcaaagatgctaactgagccactggaccacattcctgggtgatgaagctggggttgtatggcgaaagggttggagctaatctgaacttccagagtgttcctaggatttcaattaccttttaaaaaaaaaagtagggaacggctaatcacagctgggcccagaaacagcgaggtgtccttgccttcctgcccggctgccttattgtccctttcatgtctgaattcagctacccacttggccttctgtgctagcaattattggctttgtgacctagcataagatacagtgggcttccttggcattcctctgtggtcagtccctattttagacttttacttcctctgtgttctcccagacacctatacctggtgtacctgttgcctagagccctgcatgtatgtgtgcacacacatatatgtgcccctccagctcccttacataacaggtgaaatcaagagtctgattaacctgaggagctggcatctgtaggatgctgggatgaagcacaagagtctcagggagttggattgcaaggaaggaagcttgagaagggagtcagggtggaaccctccatccaccatttcctggagggaaagagctttctccacagggagagctgcccatcagacacctgggctttgtcctgcccagatagtctctggaggtcatgcatctaccattctcaaaattaggagagaggaaagagacaggcttgcctagggaccaaagacatgcgtgtgtaatatctagggatacacagcaggcattgatcatggctatttgtgtgccttactgtttcatggcagatatggcctcattgtgaacaccaccatattattggcttgctctgggaagactatgttcttgcctgctcacaaatgggcactcatgaccagaggcactggatggggaaatgtagctctctctgtacagtggagttttgtgggggctacttcttggggtctctggtgctcctctgagttgagtcatttcttcttctgttctcaccaccttccagcactcagtactttggttctttttttctctgaaacactgctgatagcctacaagtgcttatattttctttctcccaagagctcagggactgcaaattcagcttcattgaccaggaagacaccactttgttaattagtctgctttaagcgaatctggaacccaggctaggattcttgtttacttcccagatcacagggatttatagcttcattaacagttgaacacacagttttaaagcatccgagcgcaagctgatcactttgaacacccccatcctccagcagtctgttaggccccctgccttctggctggtttgtcccttacctgtttccctgggggacaccatggggaggaaagaggcaggaaaggagaaacagagaaaattggcatgagtgagtgagtgggcatcctggcttattaaatagaactgtgcagggggtaggggtgcttcagggagggcagccttagaagttttgtaacctccgtcatttaacctggtgacctagaagtacttaggaagaggagtgtgtgtgtgtgtgtgtctgtgtgtctgtgtgtctgtgtgtctgtgtgtctgtgtgtgtgtctgtgtgttcttaacagctgtgattactaatttgctgtgcttactaatttagatccatttcttcttttctccttcagggcaaaaatgattagacgaatctaattgtgcatttgtgatgacgtcagcactgtgttggctgctttgtttgcggcctactttctaatctttgtgttcactgatgtgtttcaagtacttagatcagtgactgatatttaagaattcaatatttaccgaaggagaaaatgagtacgtctgtataagtgcatacatgcccacaaagtagtttcttacatgtagttatttatttgttttagtttagtatatgtgccatgtgcatgtgtgtgtgtattggtacatgtactgatgtgtgctcatgtggaggccgtaagagggtggtaggtgtaattctttattgctcaccttatttttgagacaggagttactgaagctgaagctctctgttttggctaggctggctgcccagtgagcttcccaaatctgcctgtatcctcccagaaactgtagggttgtaggcatgcatgggccatgcctcaccttttcatgcatgctggaaaattgaactcaggtcctcttcttttatagcaagctatcttatccactgagctatctcttcagccaataaaccattgctagattaacatttagtatgcaaagtatgcaaggaattagaatgtagtacagaaatccatgaagtagctctgtaaaaatgacaagtcccacacttgcatattttgacccgtcaccattctcagcctggtcacattaggtcttgttcttgtcccaaaaatatgtcagaaatggcatattaaagatagaaacaatcaaccagacaaaccaacaaagtggacgttaacaacttcatgggaagagcaaagccaaaaagcagacatgacccctcaggggacggccatctggagctgcttggttcaggaaaaacagccattggcacttcactgtgtctttggaaactcagtcacgtggcactgtgaacactgaatcatctaaagcttaagttctcttctataacttgtcagatgaggccatatccggaaggttcctcagactcttaggtgactcagtaaccacttcttgaagagcttctttcacacacagcaggaggcagagaacaatgtttgtggtcctggaggccaaacccagcccacttcttgtctttataaataaagttttattagaagcgactgcacttcctgatttacatattcactgtggcaactttctctttcctgccagctgagtccagtaactaaaacagaaactatatagccaaccaagcaaagtttttgttgactggtcctataagaactaaagatagccagctgttcatgtagaacgtttatatagctggacgccacttgagtgttggcttctacttccatgtgcatttgattcgtctgcatgtatggccaagtactctgtgtgtacatgtgtatacacagttctgtcaggtagtaaacgcagttaagtgcagggcatcacattccctcgcttctgaaacatagctctggaggagtctgggcaaaattagttatcattcttcttgtgtcgctctgctgatgacaggggcagcgtgttataacctctgaaaaagacattctggaggaactccggttcccttggagacatctgtgcacaggtgccatcctgcagtcacttcttaagggtgtctgtatcgattgtacccaaagcttacatttacacaagatggatggccttgtgtctggaatcaatgtgaaggatttggtgagcacgtagcccagattacacgaggtccggtgggatttttaaatggtcctggaagttgactgcgaaggtgaaaaatattatttgctttagcagatagaatttttttcaggttatttttgtggtcttcttcattagcagagaaagcttcctcagccagggctactgtgctgacttattctatgctaatgtggtcagtgccacttcgtgtcaggttagaatagctctggcttcaatatactctttgtcctgccaatatcattcttcactgtatactttgagttttcaaggaatggaagccaaccctcttcatggaaagcagactttggagactgttgattaacacggtagagcatgtattaacatcaaagttagattaagacataacttggacttagagtggggaaggaaatgtctttagttttgttcttatttttagttttaagtgttagagcgtttttcctgtatgagtgtccctgtgctgtgtgtggaccatgacggcagagaggcatcagatcccttcgcactgaagttaaaggtggttgggagcctccatgttggttctgggaatcaaaccctggtcctttggaagaatgccagtgttcttaaccactgagccacctctctagccccaaccccttattttgagatttagttcatatgccacaaaaattggcactttgccgctcagtagtttttagtaaatttatcaagttgttcagtcttttttctttttttaaataagagaagattggttcagtttgaggaactttatgttgacatttgctagatggtatgtgtgtcatggattatgacagtcccagtcctttgagtttatctgatatgtggaattgtttcagcccatgggcaggctcaggatatcaagacccaatgcctaggcctctatccagagcacagcctttgggggtggctggcgtctccccttctgggattctctttcctccagtctggctgtggggtgagaggagtcttcccttctttgatgttgctcttgttagtgaactgggggatgacacacatttcagcagaaatttttggaaatatttgctagaatgtccacataccattcagcctctccatcagtcgcttccatcatctggactccttgtccagaatgggcccatgcaaatgagccttccttgcgtcactcgttcagcttccaagagccattacaatcccaccatctataaggtaagagagactgatcctctatcctttagggggcctcactaggtcctgagagtgtagagaagagagacaggtaaggtcttgttcccacagagtttctctatagtcaatgaatagaagacagttagtggctgatcatgaattcagtttatagtcaccaatgtgttgtgaaaaccaaattatatatatatacatatatacacatatattctgtaaactgtatatctgcatacatctattctgttatatggtagactttagctaaaaagttgagggcttaaaagaagcatcttgggttaaagcaccttcagtggtttagtgcacaatctccttttgtgcactctattttgattttatcttagtctttactgacatattttattatctgtattaatggacttcagtatattcccacacatgcatatactatatcctgatcaaatcttgtatcatttggtgcattaagatagtatgagaatcacttactgaacaggtgggtcaggaggtagggcagaggttgaaggggaaacactccctgggacataagccctggagccttctattgctttgttctttgagccccacctccctacagtgttccaggctacagatgttttaccatgcagatgttgatatttcttatttttgactttggttctgggttttcaaatcctccaatgacaaactgagttgaaagtgagcctttcttttcagttgaatgatgaataagagtttgtgcttgggagaccacactaggtggtcaggaaggaaaagggctgtttgaccgttagtatttagttcagagcccctggtggacagaatggctaaatatggtctctgtgtgtgtgtaagcaatagaacacacccccgactgtgtaagattttcacatgtttaaccaaataaatggcttcctgcctcttgtgggtttttcttttaaggccggcagtcatcacaccaagatgacaaaattcaagagtccacggcatcagagtcctgagtgttggctttctaagtccagggaccctaaggaaagcagagacagccttctggatgttttgctcctgcaaaaaattgtgttgttgtgtaacagctgttggtacagttctgtgcagagcacagcatgcccaaggtcctgcattccatgccgagcgcccaaacaagcaaacatgctgtttgattaaaagtatttgtgctgtactttaaaacatgaagagtgatatggacagagaagggagggggtccatcctcccctcccaaagatgagcatgtagtctatggttttcctaggtttttttgtttgtttgtttgtttgtttgtttccaatattttcccttggaaccactcagaccaattctgttcttctttcctcccaccattttctcccagaaacttcaggcaggaggtgggtgaagtgaccagtctagtttttcagctgtccattccaatttgtcaagattagcactcagtactccagagctggtgagctgaggatgagagggtagcctccgagtgagtgagtgagcgagcgagcgagcgagcaagcaagcaagcaagcaagcaagcaagcaaacagctaactgaggcctttgtaagaagctgggggtaaagaggagggggaacgtgagggaggagccaacttaaaggacttggaaaacagcaatcagagatgaagcatctagattaatgcctccctgagaaagaaacaaccaaaagtacatgttccaggtgtctgactgcacttaaggttgttgatgccggaatctgaaatacagcttccttgtggatattgaatgtcttagcaacttggtgtgatgccctgcagaagctgtaattatatctgtgtggaggccacctgaagcttaagacaggagcaggttaaatctgtaaatcacaagaactgtttataatatgtaagactttgcctttgacccagcttttccatgggatgtgagctcatttttcactttgagccaagagtgggagatgatgccatgagattcagtgagtgattcaggtctatatccaaatcagggcagtggcagctaatgtgaaccaagcagagagtttttcatgaatctctgtctgtctgtctcagagtatggtgtgtgtgttatagatacatgtttgtgtgcatatgtgtagttcacacttggactcgtgaaggctagaagttgacattggccatctttctccatccctcttcatcttctctttctgagacaagctctccctgaacctggagctcatgagcttggctagagtagctggctgataatctccaggcacctgtctgtctgtacctccccagggctggggtcacagaggtgtgctgctcctcatgccttttaaatggggcctggggaatctgaactcagggcctcacgtttgagcgtcgagcactttatcaactgagccatgtctctgagccccttcttccacccttagactttacagttcccctccccacagtaggttataggtagagtagatattgtcctcaccactgacaattaaacacaaattctttccttgtaacgaataccccattcatcaatgacaggaacccagctgacaactcctgtcagcgtgtgaaagttttgacaggctggaacagcaataaaaaaaatcatgagacattgacttacaattcatggaacatcagccttccaccagcgaagaacaggtggaagtgtggtttggacttaggtggtggaatcacaaacacaaacaaacaaacaaacagaaagctttgtctatcccagctgtcacagagggtaacaaagctacaagacccagaaggcagtgtctggccagtgggtgctgaaggggttccttagtggagtctctgcatgttcttgggaatctagctatggccctggttctggcctgctcaggttggaatccctccccacctttccttccctcctatctccatttgtttcccctgcacttctgtgtagaatttatttgaaaacaagcatccccacccccctttgaaaatcactcccttaagtatcaagtgtgtaggcctgaggatggcaaactcattcccagtgaacaaaaatctgccaggatccagacagccttgaggtttgttgagatgacaatgccttagacatagctttttctaaacttcatgcttgtccgtgtcattctgcataagaataaacagggggttctgcctctttcatgcacattcccaattccatctaaagcattgctgactaggagagatgcttcatcatatgcaccttaaaatatggagatgtgtgtgtgtgtatgcatgcatttatctaatagtcacggtaagttttgtgctctcttgggcatttcagcactgtgtgctgttagatcttattgttaacctgacacaacctcaagttatctgggaagagggaaccttaactgaggaattctgtagatcacattgggctctaggcacatctgtggcggcattgttttgattgttaatggatggagaaggaccccgcccactgttggctgtcctgtccctacccagctggtcctgggctacacagcaagctagctgagctagccagagagtgagccaagaatcagtattcctccgtggcttctgtttgagttcttgcccttgcttcccccagtgatggattgtgtgacctggaagtgtaagtcaaacaaacccttccctcctctaaggtgctctggctcaacaagttttatcacaggaagaggaaatgtaaactagaatactcagcctttgaccatggacgtatatctgaatgtcctgtgttggctgttgactggagggaaaagaggctcaaagcaattaccttagctttgctttttacattaaagatggggtgaggtgtccatggtcctcactctgtctgcatcctgtcttcagtttgtgtgaagatggaacccagagccccttcctgctggggacccctctcctccctcctatcacctcttagcctctactgacagttgtctggggaatgtcaggactcggcacagcaagcctttcatccctgcctgtgcctcttgtcacaggaagctggaggttgggtcagttgtcatctgctctctacatcccaactgcttactgtgacagcgcggaatgcacattccattatcagagaaagtctcagtgcctttggcctttcttctgtgagagcctttcatcttcactttgtaacttctcagatcacatctgttttctcccgtgcccttgaccaccgagtttggtatctgttcttccttgctatttcccactgtttttccctcagctgaaaggaacagagagaatggcttttgataagaactggatttatttggaagcaagcagatcagcacccatctttctactggaatacaaaaatgatgtcaaattaactttcaagttaaagaaaaattaatagaagtgctcttttaaaaagtatatatatcgttgtcatcatcatcattgtcacatcatcatcattgtgtgtgtgtgtgtgtatgtgatgtgtgtgtgtgtgtgtgtgtgtgtgtgtatgtgatgtgtgtgtgtgtgtattctaagccaactgtggaggtattgatcttcgacctttttctctgccctcactccatgtgacccaaccccctttcataattttagtacttttatcattgacttcctcaactatgcctccattccaaatttcatccctgaatttgacttaatagcttattggtccatttgtgctgctataatgtaaatcacaatcctggtgacttataagcaacaagttcatgttttcagaggtctgaggactggggaattgaagatcaaggcagattttatcctgtttttatatgtcatctcctccctgtgtcctcccatgctggaagggtgtgggagctctctggggcctctgttatagtcctcgtgcccttgggtcctggccactttgcaaaggtccaagagcatagtgatcatctgaatgtcaactgaatggatttggggggcatttgttggacgacagcagtcccactgagctcttctccgccattttcctctttatttgttccactgtagccaggctggctttttgctgctcctaagcacaatggctgtctcaggccagagccttggaatgtacctacttctttgcctggccctcttcttcaaagagctggttgtagctcacagcaactcctttcaggtctcccttcacagagaggccgcctgtgcccctcactctgattccaaaagccccctttcctctgcctgccttattgtttcccatgtttcatgtgggctgggccacctccgatcatttactccatgttagcatggctaggcattgcttatttgacccattactgtttctaggggttcaatacattaatttccatagtatcccatgcttttatcaccacaggaatgcatagctgtatgcttccaaaactccatgagctgagttaggtttaaatgtttttttctttgattgtaaatttattcccatttagagactgaataaaataatgaatatgtaagcgaatcatatttcctcccttattaagttttcagacacatataaatgtgcctaaacctgtaataaaagattccagaagattttataacatgttttttagttgatggtggttataaataggaatggtttaaataacattaacaagttatggtctggctaaagggccatcatatttcgaagaggaaaacatcaataatcttactttactactttcccaaacctttgaaatacatagaactcattaatgttgaagcatttaatagaagcaaaagaaaacaacaaaaatccactgtgatagtaactgccaagagtttaaaggttttttttaataatgcctcaacaatattggattaatgaattagcttctcagaaaaaaggctggactcagttaacataaattgggttctactatttgcagaagcagcaactaaaattctgcttgtaaataatactagggaaagatctggaatgaatcaagccgctgtcacagctgggctgtgttttcagctctcaaacacaggagaattaatattgactataactgtatttgaagctcaaagaacacaaaaaaatgaagtcctttgagaataagcttttgtacaaattcagcagggaaccacatgagaaagcactttccagagacagactcccaaaggctttgtctaggaacagttttaaagtcttgtgggacacctcttggccctgccattgtgagtagacagtcctgagtacagtttgtatataattgccacagtcttttccctaaagataggggattcaggcagtgcttgtgaagtcagctggcctggtgctgctgggttggtggacacaataagttctggtcaagggcagctcagcaggtccagagctatgtactgtctgtctgtctgggaacagtcccaggactgcagagtccttgaatgtaagctcttgccaggctgaagcttttctttgtggaggcagttcctggagagtcccaaccatctccggatagacaaggccaagaagcacagagaagtggacctttaggtggctgcatggctctcaggagacaccgtagcccactctgaagcacaccctgtttcagaccgtagagactgccagtaatctctaagaatggggtggtaatactctcaggcctaccactttcctgtccaacgtgcactttcccaaaccatcaaggcccaaacaaggcttcacagagctttcttccagatgcaaatgtcctggtgcactgtggatgttctattgttctgcaccctgagggctgctcaggcttgcttctcagaaccactcagggctgggctctgggaaaaactgctggttaggcaggcctcttgtttaatgggaacatctcttctagtctgcagccagagcattcatggttcagttcttcctagatgcagagactctgggcaaccatctctaagtcatctattctcttggcttgcctctgaagtggcttctagcagacagttggatggcaggagactgttggttttttttttttttttttttttctggaaagttccattcgtctgcccggccacctcagcagtaagaggaagtggcaaggaagtgacttgtcacaagtgttttgtgactgtgggcacagtattctaatgtgggtgctaataaagaccaggcagatcatgagctgtggtagtctttgtctgttttgacccatctgtgtggtacttagctgaaagcttgcctctggccagacatggggtcagcaaatggagagggacattgtaccaggcttggcacttgcatcttggcccttcatacttgaatgcttacttgggtggtctctttgctgttctatgtcacctcttctgatacgtaggccttgaaccattagctgcaagctgagccatgcaccatcaggcctggcttacatcccagctgtgcttttttgaatattaagcacaggaaaatcttagcatctgtaagaatggcatgctgtgtttgcagggcccatcatacagtacttttgtgtctgtgatctattccatcttcatgtaaatgcccagggaagaggagtctacttgcctgtttgataaggaaattcagacctgaagaactgagtgaggcagatgctgggaaggtagttcagtaggtaaagtgcttgctgcaggaggctcagggctaggcttcagagccttagaaacccatgtaaatgctgggtgtgtctagtggcctgcatgtgattccagcctcagaagacaaagacagaattccctggacaaactggccatggtgacgttgttgagctctagatttgagtgagagactgcctcgatggctagaaattaagagcaattgagggtgattcctgacagcaacctcaggcttccacattcatgcccacacacatgtacacatgaatgcccacacacatgtacacatgaatgcccacacacatgtacatatgcatgcccacacacatgtacacatgcatgcccacacattcatgtgtgcacgtatatgtgcgcacgtgagcgtgtgtacacacacacacacacacatttgaaaaatgataaagaaagattgaatgacttaccacagtgatcaaactggaaaatagcaaagcttaagccttaaactaaaacctaggtgttcagaatgaagtccagagctatttactgagtccccacatgcagagggcagactgctttctctctggaatctttaattgtagtgtgttttgtaatatccataaactttagaactgcgttagctttgtgacatggaccaaaggaatgcacaagtcgacactaaacaagcgaggaatgaccgacgctgttgaatgaagaggtgtgagtgaacgtgcaagatgaatgactagagaactcgacaaagctttacttgccctcatattggaaagctctgcactgtaaaatgctactgtacagtttaggactgtgaccacgtgcagcatgtcacacctaagcttttcctctcttctgatagatggtgaatgtgaacagacggagtcagggtcacaccaagggtgttgataaatccacaagcaaaagtcaaaatcaagacctatttaagaaggtcttgtctggtatgatctcccccccccccctttacagttccctagaacatactcagggcagagttttgtgctagatttttggtttggatttttcgccagactacgtgaatcacgataaacattttacggccctcccttttcaagatcaagctggaagtgtgacagaggcaggcttggaagaagactgagttttcttcctgtgtttgaaaatcttaattttcagccagaccttttcccaaaagcttattgtggaaggaaggaggatcgctgagtctcgggaatttgattggtggaatgcaggaataaagaaatgacaggtatcagacatttggaaatctggaattgagtgggctgtgcttgctttgatgggtggcacctattacacaacccagtttctcaagtcgttcattacatacagcacacacggaggaggggctaagctagtctcagcgggaggtctttgtaggggatcagtctcaggctgcagtcatccatccatccatccaggaggaggaagctgtggttgctagcttttgcacacattgttcagttgttcattaatcctagcacttggaccagaaggtggctttgccatttccatggatctgagacattggggtcgttgcccatgtccgtgtcagcaatacacttgggacttcatcttctccccacagagggtaaggagtgacctctagatttatgtagtccttcttcctcaaataagtgtgcatgagtttggtgatggaggacctcagaagtaggtttagagaagttgttggttctagtacaggcatcttgtgccaggttttgatgggatgttctaactgcggttccagggtatgctaagccatttctagtgtatcaaggatggagatactaacatgcaatgagggctagggatgggtgaatgggtaaggtggtttctagtaaccatgtaaaagctgggtgcaatagcatagtctataatcactgcctgtggggaagcagaggcagacagatctctggagctcattggccagccaggccagccaaataaatgagcattgggtttagtgagaccctttctcaaaacacaaagcagaaaggtgctgaggagggtaccactggtccctacatgcacgcaacacttgctcatataatcatagtatataacacacgcacacacacacacacacacacacacacacacacacacacacacgtattgttcagctctggcctctaaggctctctaagggtctcctccagccttgggcatttaggtcagagtctgtgatttccctcaaacaaagcaaagccagcacaggcctggtaaatggtctgagctacgtaaatgtgggtttgttattttgaaagaacaaagaaattcttggtgtcttctgtcaccaaattacatcttcagatgactttgtcttcttgtggcactgcttttctttctccagaagggaaactgcacagttaccatgatgggaagtctggccagaggtttgaaattatcttatagacaaagccacctccgttgtccccgttgttaccctgggcaagagacaaatgtaaataacagactccagaagccgtccttgaagctatgtaccaaatccacatttttaagtgaccaagaactgggactccaagtcctttccactgcacgcttgcctagaaacagctggtggctctctgagccacgacactgtcatcaggaagggaactgtctataatgccagtgagagggaagaataggggctgggacgagtgtccaggatgtgacttctaccagcgtgtggggcttatagtagtctgagggttgtcatacaccctccaaacccagcttcactgccagcttccgctggagcagagcattaagggaatgagccatgtagagtttagtgttttatgtccaaggaaaatcaaggacagaaacctaggctgtgtgtctgggtataaaatacctggcctcctttaccttgcaagagactttcctccactgagagtcatgtggagggatcctgtgaagttcaaaggttagggtttctgccatgacataaagttatttggggataggtagttatgtattaaggtcagagaggggcgcattctgtgctctgtaaggtacagaggttaacaacaggttaacaggtttgtctctacccactagttgtcactacctggtcttagttatgacaggaaacaaacaaaacaaagcaaacgaatagtttttaaatgtcctgtggtcagaacagcagtgcctgccaccattggcagcctgaagggactgagtgaggaagctccgtggtgctgttctgtccttagcctttgtactgagcttaagaaccccttgccatgtctggaatgttctttgtaaagagcggtcacctggcattaagtttctcacaggagacagagtcacacatgaaccaatgagacccctgtcctttctcccctccttatgtctgtggccctttcctcccctccctctgtgacctcccggagggctcgttagctcttgagttccagagcccttcttccaagattccaccaggtgcccagtgtgcgtctaagggaagacagggcctgcctgctgaggggttgctcaggcagggggctgtggtgaagcagcatcttgaccaaggtgactagacccctcctgtactgtcaggacactgaaatgtctcagcctggttaccactttgagaacagactccaggggggccaagactagaggttgccactgagatgaaaccttatggcatgctttctgcctcctggaaactggctgtgattgtggagatagaacacgcatctctctcataaggaagtatttgctgagtcccatgactcagaacagactgacgctgtggcctagcaagaatgagcgtgtgtgtgtgtatgtgtgtgtgtgtgtgtgtgtgtgtgtgtgtccgtccattaaaatgtacactttgacacatttggacacaagtgcacacacccacaaaggtatcctcagtgacaataatgagcaaacctttaacctccaaaagtatactatgggttcaagtggagggaagaaatgttactagggcggggacctcagtagagtcatagagatggtgtgtcagggaagagggttacaaggacttttgtgggacaaaggggagccatgctgatcctatagggagataccctgagctgccaggtcaggttgtgacagtcagcttgaggaggtaggtgaaggctggagtgctgggccacaagcaccagctctgggggagctgttgaagcagtcagatctgctctggaatgtggtcagagcagaactttttagcattttattctttaaatccccataactacattttaggagttttccatttttgtagtaaatccaggaaaatgtagccaagtacattggctcagtgtttcatacatagaaagcagtgaaagggagaaccatagacagttaatagattttaaacagccccatgcagccagagtgtcgcacagagtgggtgtacttccgctgcacctggctgtggtgccctgcacctacacaggatcaagcctgtgatgggtttcagtaactggaaataaaaataatctaagtaaaattcagcattcaggtgccttttcagtatactcgtgtgtgtgtgtgtgtgtgtgtgtgtgtgtgtgtatacatgctctctctctttctttctctctctctctctctctctctctctctctctctctctcacacacacacacacacacacacacacacacacacagagtgatgaaattgactctgcatgtgaatataaggccagaggtcaatcagtgttgagtatacactctctacttcattttttgtgacagtgtctttactttatgaggagtttgacattttggctagagtggctctctagagagtcccctggaatccacccatcgagatgccccaaaacccaggattacagatgtgggctgctgctcctggctcttacatggatgctgtgggtctgaacttgggttctcgctcttgtacaaggaagccctttactcctgagccatctccctgtcccatgtgactcctttgaagagactaatggtaaccacttttcagttgaccagttccagtgaaaatcataggctcagctgccatagaaaccaacaactcttagatgagttgaacctttaaaatagagaagaaactaggcgccattcaaagagcagcccaagagatttgagttaagtcctcaacttctccagttatagaggctggtacctgagattttatatgtgtgtatatatgtacatatgtgtgtgtatgtacatatacatgcataagtataattttccctttttgtagttataaaaacagtctcagttcttctggataaagtaaaatgtaaggtaattgccaccattatcaccaccactgccactttgagggtgtgggagatagctcagtggcttgctgaatgagcgtgaggactggagtttgggtccacagcatctacatgaatgacggcaggtgtggtaccctgcctgtatcccaatgcttggaaggtggagatcagaagagtgagctggccaaccagccagataagttgggtagttccaggttcaggcaggcttcagtacataatgtgtagggtgaccaaagaagatgaccgatatcaacctctacctacatgcacacacacgtgcatgaccactattcacctgtgcctatgcatgtgtgaccacacacccacgtatgccacagacacacactttcagtaatgataacaataaaaaatagaattctcccttttcttttaaagtaggaagatattattgttattcttcttcagtaactttaaatatgatttattcaatgtctcttacatgacatggttgtgaattatttctaatgcttacaactctataatctgggtgatttgttttcacttagcagttgacagaatcaaggatcagatgaattgcagagtcccaggttcagacaggtctcgatatataatgtgttggctgatccaggaagatgaccaatgtcatctggcttctaggagccaggacagaacatctttctatgcttgtacctttcttcttctgcattctagttttgacagaatggctctgtttgtttatttgattttctcagtgggtgtttctcacccccatctctgggtgtattctgggacattcaagagcccggtggtggcatgggctcagttctagtgacaagggaggcatgtgatgtcctgtggtaaaagacacagcacatgcatgcaagcacgtctgtctgtctgtctgcctgtctgtctgagcagagagtgcttgtttacattttccttatcctgttaattgcttgctacctgccttggtgcagccgagctccacgcatgtggaacagtcgttcccactgaagctgcacactcatgctggggaggctcacatctttgcagtggtccagagcaggatggcacaatcatgacatctcagcctaatttagtttcttatgtaaaacaactttggtctgacatttaacatttctcccttcggtgggttttttttccccttttgtctctctgagctcattacccagcatgtctttatacctttacacacacacacacccacacacactcaccaggattcatattcatgtgcacagcaatatatgatcttcattactggggaagtgccactagctcacagaacagactaacaatggtggcaaatcctgggtccaggaaaggtagccagaagtttctattgaggttgtacattaatgaagtagaactgtgagcagcctctctcaagcaagcttcttgctgggagaatgtgtcccctgccaatcagagggacccgctgctcagggacagagccctggaggctgggcacccttcctacaaagagcaaccgcacatcatggcttcgtccaacatgctaattcattccctggcttatctgcagaggtaggcagagtcatcatctgttgtctgggaattccaggaacagcaggaatggaggctacagacttggcttttctctgttaattcttgctgagtagatccaacaacaccaagggtgagggagactctggccaatattcctctttagatcccgctcctcacttccacccgagcctccgctttaaaaatcgtcaccatcaaacccctgtggaaaatgacatggaaattcagggaagctcaaaagccataaaaggcagaaacttcttgtgggaatatgtgtttgaaggggtgaaccactctggtttccagtgtttaaagtgcccttgctcacagggtgagcaagctatggccacactctcttgaagtagaaacctcacttctccgagagagacactgcatccaaatatttggactctgatgggaacgggctgttatccttaggtctacttgacttaaagttggttatctattgattcacaaatgttcaatctcataatttaccttcagaagactcattaataaggacacctgccttggtcaagacagagcagccataaagagcacctggggagaaaggacactcagcaggaaaggtgacagggtgggagtgcaaactctaggccagggggtggtgttctcccggagtgtgaaggcaaatccccttgatctgagaagctgcctgctgggcaaaataaaacattgtattctcagggccctatggtcttttccaagcctcaagggccagttgtttatggagggagagacttcaggaacaaagtggcaagaaactgcctttgaagaacagcttaaatcttgtgcagtctgtctctagaggcctcgagagtaagaaaccaggagcaaacatcaccaggaatttgtacaacacatgctggatgctgactccagctgttgccttcatcacagacccagaggcttcggaggaacacatgcaaagcactcttggctaaaacagagcacggaatcaccttgccctcaacagtggcatcagcgtttattgctaagcaaccgatcccgaggagactgaaatacagaacagaaagcaaccaggagcatccataaacaccaccgtctgcctggccaggcttttcttgcctgagccctgcagattctgcagccctcattacaggtccctcatccattgaaaatctactaccacctgcttgctaggggccaacctcagtgaaccactaactggaatactgatccagaatttctcagctgtaatgatgatcatggagtaatggtttaagtccattctatgtaaaggtctagaaatttaggaaagagatgaaaagattagctgaggcccgagaatctattaatatcaaggcagaagcagtaaaaggagattggccacatgaggcccttcagtcaggcacaatggttatgactgggaagagttctgagcctgagagtcaaatgcttcagtgtcccttcagccagctggctgtcactgtagcaaataccagagatgaccaagttaaaattagaaaaagtattgtggtctcatggttcatacacttcatggtcagtgggctactgctctttagctctcccgggagggtatcagacagcagtgttggggaatccatgtcagagtaaacctgatcacttccccaccaggaaatgaaaggggtgggaaggggccacagtccctttcaaaggcctctccagatatcttaatgacgtctggctaggtcctgccccttaaaggccacagcagcactcttacttagctcatgagactgggggaacatttaagatgcatagagatttatttataaaaagcaaaggagagatggtcattggatgaatttgttattcagtggctttaacctagagtgcacccgtatcattcattcattccttcctttactcactcactcattcattcgcttcacaagtgttcttgtgagattcctgtgtaaaaggtagtgtgctaaacattgaaggacttaaaagccaaaggaatagtttctctttcacagctcagagtccaatggagaagtaactgtgtaattaaacacgaccaacaggcacctaggccttggaattgaagattgaaaaaggagggatgatggcatcagatgtgtattttactacaactattgtaggggtggagggaagtcatgactaggtgtgaggagaccatgtgaccaggtgaagggggggatgctaaatgcattaacatggctgtgggaatcagagagaaggctagcctggagcatggaggcagcagcacaaagaggatagacagggtgaggctttctagaaacttccatttagaaagtttggtgattggatgtgaatgaaaagcagacaaagacgattttagatttctaccctgagtagggtagctaattatgtcatttgcttagagagtgattacgggagtgaaagaagattttgggacaaagggatttagtatggagttgtcattttgaaggatggttttgaatgggtatattgcagaagctgaataggcagggacagaaaagccggaattcctagacaccgtggtaatgatgtgtatggtcattgaggccaggatcacgggggtagttacctgtgggaattaaatctcccagatatatgacccagtctaagggagtcatcagactgagagagtaccccataggttagaacaggagacacgtttctcgaaatccccctggaacaagcagcaaagcaattatggcacccaacagccacactatggagttccctttgttcctttgtagtcattacaaactgtgacagcttagatgcgtgaacgttaacttcactacctccttccttctgaggactatcaccaggtactcagacatcttttcaaattcctcttcatgtgagagatgagacaaaaaataatttttgcatattttctttgaaagataagagtactttgagctttaaaatttaggctaaaatattgcataggtgccaaaggctcgttttcatatgtgctgaagtaaaaatggaggtgataaaatcgaggttctgcctgtgtgtggtttatgctgctccaatttgatgattttctgaggtcataaggtgggtcagaggcagaacagcacacgtatctcaatgcccataagcaaggcagatgtcagactagggggctagctctctatctctggctttgctaatgtagtagttcctcttatattcatcttctgagccctcagtcctctctgtgtccatgtcaggaaaggccagcaagtatatgctgtctacagcttccttctctgtttgcttctacctccaaatgacactgactcctctctgtcttagcatatgcagaaggcaatgactattgacccttcctctttgaagtcttcagtcaatctaaaacatttatagtgtgcagaaaagccctagaaagacatgttggttcccgaatatgtctctctgcacttgttgaaacctaaggatggtactagctatcgtagggcttttgaatcaagagctgcttaagtgaagagacagctcttggttaccagccagcaactgatgactcattatccttcctcttctggagatagcagtgggtcactggcaacttcttggcagcctgagccaatatattagaaataggcccagctgtggcattagccggtttgctggctgtcttaggtctggtattggttgtaggtggaaaagagtgttaaggatctagagccctcaaagatggcttgtaactcaaagagctacagagtttcatagtgtgcctgtgttgatggatcctggagtcacctcagattagactagaggggcaggagaagggtgtggcatttgataatctagaagccaagaaggcctcctggatgtgacctcacataggacaggagttgtccatagcttcacagcttggtgtactgattggcactttggaagcttatcaatttaaaacatatcaatttgttaaatgttggaaactgagttataaatagtaacaggctgaatatagaagggattacttcagggaagggcagtaaaagtcaaagacaggggtgaaggagttttcagaatcagagttgctcatgagctctggagggcagatgtgtttctgtgtcaatcaaatttagaacctacgcctagcactccaaatccaaaataccacgaagtctgcacatgacttttcttgtagccacaggcttactgtaatatgtcttccttatgattgagttaacaatggtaatattttaggcaggtcttatgtaaccagcgtggcctggaactcactctatatctgagaatgatcttaaacagttggtccttctacctccccttcctgaatcctgaaacagaaggcttccattaccacttcaggtttatatggtgccctgggtcaaacccatggctttgggcatgtttgccaagtgccctaccaattgagttacccagcaaaagcattgaagataagcaattagaggtttcttgaagcccaggagattattagtgactggaaagcatatgctgttgactgtggagtctgttaaactgcccttctcaagagcgtgtgcagatagatgtcttctcagattatattaaactatgcagtagaatgtgggaatgacctagacaatggtggaatgaccaaaggacaaaatacctcatgagcatttaaagtaacatttgagagtggtatttgttgatggggaagttttcttatgtaatgtcatgtggcaaagcaataaactatttcgtgacatatgggggggcatataaatgccttttgaattaaatgaacatttcctataaaactgtgaaaagcccacacggatgtgttctttgactcttgaagtgaacaatcatggacaagtgagtagtcaagacggtccacagtacagcgcaggttgtatccaaaaggatctgcttttgtggtaaactgaggtgacagtctcctctagaatggccccctcaggggttctttcgggtcccacatgcttttgagctgtgattaaggactgcctggacaaagcagctgtcaccgagcaggcccccacagtgagccttgtctggtttgcaaggcttttccaggcggaacccaatcatctcagcctcccagcgctccagccactttataggccgccttgagtttctgcctcccgagccttgctcgatgctgctctgtgaagaggcctcttgatttattaatcaattaatcagtgcacaccgaggagctgctcagggtagttaaacagggaaaacaaaacgctggggtccatcacgcagacagattgtgattaggaacaaacctcccactgaccgatcttcctgcccaccatggctgcatggctgccccgagttacctttcagacatgctactccgtccagatgggcctcagatctataaaactgacactgtttttctgaagggtgatatatatatgtatttttgcatccttgaagaaaatgactccaaagatgagcctcattcattcctcataataactgttgagccttgcaaactctgccaggccccaaacatgctgtggtgggtctgttcatctgtgcatgggcagagctgtgccatcccactttccccacgagggaagaagtcctagggctgaaaggatagctcagcaaaggcagggcgcagtggctgcatgactgaggagaggttccgtgtgctgagtgccttatctaagggtacatgggactcccaaggtcataaggaaatactttcacacccatttgcatcaccagggctgtttcttcatgtaatctagtttttgtggaagttaaagcaaatgagagtcagagtgctcactacccccacttctctctcagctatgacctcagagcatgagatacaggagtgagggttgggacagaggcctcacgtcatagcccaggctaggctggagcctacagtagtcctcctcagctcctctagagctgccatttacaggtgtgagccactccacctggctgatgagttttcagtagtagttttaagtaaaacttgtgggggaagcatcttggattggtcaggaaatgagaacaacagtccagaagattgggtggggggggtggtcctcatgaggccagtgacaggtcagagtttgctggcagaggtgtgctggctgctggagcaggctggatcctggttctagaatctattggttagttttctttcctgtggtgctgacttagcacacacgctgctgaggccaaagtttggcagaatagggtctctgttcccagtcgaaagtgacacttctgtcctttgccagttctctgccaccaagaatgaggtacacacccccaccatgctggactagggagaaagcagattgtctgcaattatttagtggacataggagaatctgaaatgttccccattgactgagtggaaggaacaccatgagagtgtgttctgtttagtatctttaaggttttcagcttctaactcttgcataatgtctgccatctaatgcttttcctctggcatcttcctggtgatgtcaatcaaatagtcaaatccttgggtggcagacgtctgaactggatttaccaccatccagttacaaattgctcttttttttttcttcctgtttgtgtgttctgtaggaccctgctttctctgctgtgattcacgacaaactccaggttcccaatactatcaggaagtcgtggaatgaccgagacaaccgctgtgacatttgtgccacacacctgaaccagctaaagcaggaagccatccaaatggtgctgaccttggagcaggcagctggcagcgagcactatgacacctctctgggctcaccccctccgatctccagcattcccacactggtggggtctcgccacatgggtgggctccagcagcccagggagtgggcctttgtgcctgccccctatgccacttctacctacacaggccttgtcaacaaacacagcggcaaacccaacagccttggggtcagcaacggagcggaaaagaagagtggctccccaacccaccaggccaaggtcagcctccagatggccaccagtcccagcaatggaaacatcctcaactcggtggccattcaggctcatcaatatctagacggcacctggtccctttcaagaaccaatggggttaccctgtacccctaccaggtaagcacccctaaaatcagggaagtagagggttttcctccctggatattgaaatgaacacatactcccgatctccctctacaagtcagagtcgaggcagaggtaggctatatcttctttctccttctggaagctcctagctcagtgcttcaggcttccatgtaaccctgcagagttctcgccaagaagctccagccaggcctgcttgcttggagagactctctgtcaactaccaatcctgccaccttcttgcttagctaacatatcttctccctaggagctcatgttagttcagacaatgtcaaggacttcctagccaccagctttactgtgtagtatagtgattaagagcaaagacctaaaaatgcttgaactgggccgatcacctgtcttgtatatatactagcaaaatgacttggcacaaagggataaccctacctcaggatcaaatctctcactttggaattgatacaatagtaggaggattaagcaaaggtatgtctataagacacatagtatattgtctaggatatgatccaatattgtgcctgataataggagatttacgaattaagacaaataggtaagaacatttttaccccaagactgcactagctctctaaaattaggatttttaaaaagcaattgatgagttagtcagggcatcactaataacttagatggagtttattgatgttgtattgtttatagatgaaggtctatattggcatccaactgtcactacctgtaccttctgaaagggttggggaagaacctcttgtacctaggaggacctttactgctttctactttagtttcatatttaacatgttggaactggtcacaaaaggcttcccactcggttttctccttcctgtgaccccgcccccttcccccacttctttaggtaatgcaatgagcacatgccaccaggtctcggtattcaaaagtaagagcaggtctcaagtctgaagaaaaaaaattagttctgatctagacatggtagtgcatacctagatagaaaaatctagagtttcagactagcctggacaacagagacagttcaaagccaacctgaggtacagagtgatgccttgtctcagaaacagcaaaaaaccccaaaacacaaactaaaccaaccaagccaaaagatgagaaaaatcattagtcctgattccccagggagctttctattggaagaacatgtgtcttctgtgtcttaactgtcattgacatggaaaggtagccacagtcacggggtgttaggagtgtcactggtatatgagatagtcctgaataccttgggtcacttctcagacgtgctgtgtcatatggggtgagaagccttccattatcatatggggacccaggcttccttcatcaacagcgtccccatccttcatgggcctcaagttcctccactagattgtctgtaaccagccaagaaatggtgtgtgtgtgtgtgtaggctcccatcgtgggtttgaggcctagtctgggtatacagtgcttccattcatactctgccgtcaagaatccagtgctctagcctcacttccctgcaggagaaactgggaaagccaacccgcctgtgtgcccagaagaaaaacaaaccaattgaggttacacagagccgttttgtgacctgagaccaaaatatggggacgcataaaatgaactcaatgtgtctgatcaaatgtgaatatcttttagttccccccaaagaattttatttaatcgtgcagtgggcctagatggttagatctttttgtgatcaaggaatatgatgctcagagaaagcaagtgacctatgactacacagccagagacagacagactaacactagctctctcctcttctcctctccaacccatttcccaagtgtgttgcttccagtttccctagtttggccctgtgtgatcctgtcagcaattttcccatacatggcttcctttgagacccagaacagcaaggaaaacaaccgttattttgaccttcagggctgagcatccatttgacttttagatgaagtttgtgtggttaatctacatataccacattatatcacataactatgtatttatatactgtataaataaggaaaagaaccaataaggaaacctttaaggagactttgtagcctagtcttgaaagtcacttcatagggctgtgtgttagctttcttctctctctctctctctctctctctctctctctctctctctttctctctccctttctttctttccttttggtttttaaatttctggttattcatatcttgtctgtatttatgtatgtgagtgtgtgcttggtgcccacagaacccagaaaaggatgtcaaatctcctagaactagagttacagactgtggtaagctaaaatgggaatggagggaatcaaacctgggtcctctgtctgagcaacaggtgctcttaaccactgagccatcttccagcatctgtcgtagtgtcccatcggtataacagatataaagaacgatgcactgacagaagagaaatgtcattgtccttactgttttgaggtgtcggtctgtgatcagctggcctctgtattaattgcattccttgtcactctgactgaataactgacaaacaacttaagggggtaagttttatcttagctcatagttgaaaatgatacaggccgttatggcggggaaagcatgaagatgaaccactctgtggtagcatgcggctgggatggcttccctccttgcatcttgacagaacaggggcaaagatagaaattctggtgccaatctggttttctcttttacataaccacgttcaaaattggacttggctcctcagttaatctttcctgaaagtaagcccacagatatgcccagaggtgtatttctcctgagtttctaaacctcataggtgtggtgagacaaactatgtattacctaattgctaaaagaggatcccaaagcctgctcagggcatgctcccaatgacagaaagaccttgcattcggccctacttcttaaagattctaccatcttccagtggtgccattctaagaccaagccttatcatataggccccaggggaacaatcagttcccaaactagagctgtcaggaacagaagatgtcttctttcaaagttataagaagtaaagcatacttgttttaaaataaaatggagactgtgtggggaaaaaattaggtgtgatttctgaaagcccgtatcacatagaaacgcattatctagtcattcacaatttgtaaacttgtgaagagacccagtgctttggcttctgctttatcgcctggcgtattttcccatggtgttatttatttttctgaaatgcagtctttggggtagctcactggaaggctgctggtttagtacttgcaaggccctccttctcatatctagcaccagtatgatgtctaacgttaccatgctattctatattgaggaacatttactctatgaaggtattctaatggatctaacaagcatcactattagagtctatgttttgtgagtataaattgcacggccaggaaacagccttcctggggggtggggggagtgtttttaccatgtctctgatagtgctagctgttacacaggcaagtcccatcttaccttccacactggaagccatgagagccgtatagactcaactgctgttccattactgatgtcacaaggacaatgggttaggaccacagctgtaatagaaaatacccagggatggagatgggtgagagggacaatctacaagatgcctaaaaggaagtgtggctgttacgggtgtgttccttttgtaatatattcacaataattctcactttcttctgccccatctcagatgaaagagaattgcctgcacaagaaccagtattattattttttaaagccctttgtcatagagtaggcaccgtgctatttgttgggtgtggctgcctccttaggctaaaaacccgtgttcctgtcctgtggtcttcacagtgagggagaagccaggcatgttacacatgatgaggttggcagctaagtgcaaaagtggagtggtgcttgtccactctgagactttggaggaactggaatccagctcttgttgtagctcaaaatcagattcaaagatgacagggacaaatttccatcttggaattgtccgggatacattttattggcaatgtcagagctgaccgactcatgtgccacccaccccccaccccccgccaagtaatgattaaagggaccggaggaaatctctctgggataaagagatttggggtctggctatgaatcagtatcccacgtgttgtgactatatcgcccagatgccctgaggcgtgggctctgggtctggcagactgagtgtctcctgttgtgaacatctccctgcagtaaatattctgtagtccgcagtctagccagctcgtcagagatggttgactgctctggaagccagctgtagttcccctactcacccacactcccacttccctctgtggagcagatttcctcgggcccagagccagagtgttccttgagcagggaagcagctcgagtttaatgagtgttgagggtacggttccactcccgggaacctgagccggtggagatgttatataaagaactgtccttctgaacctcagatgcagtaagggtgatgaagaagagaccaggcttccaacagggagcctatatcctttgtgaagtgcctgcctcacaagaggaaaggggggggggaggagaataatttaggaggcagtgagaaatgataaatcacaaaggcaacttcttgcgaaatatctttgagaattcatttcagaggcaaccatgaggtgagccgtttcacagccggactttcttctattgacgtcctgacctgacactctgtgtaatgtaaatacgcacaaataagaacgtgcctgtcgactgtcctttggccatgtgagttttgacactaaaaggatatgaggatatcagccctcctgctcatctataggttaattatctccttccaaacggaagctgctttggcctgattcattctcacaacggtaaatggccacaggaaaactggtagtctcaggtggccggcattaggaatccatttctggctcctgcaccaaaggagtgagggtctgatggagacttctccttggtatcacaaactatggcgtcacaaaggccaccatttctagatggatgaaaggcaggtatttatttatctttatagatgtcccctccccataaactctgaacacaggaaaaagaatgtgtctgtgtatttggccactcatagtacatttctcaaggatgtgaaatctgggctgaaagtcgaaaggaatggtcacatcttatgaatggtggatagggtcttggtcagcaaggagttcccagactgtatcaggaggcttaaacaatgctttaaatctggtcatgcattttgtatggttgactaaggaagggccctgagaggtgttcgtgcccagctcagtctatggttgtggaaccctgattaggattttgtaggatccatgaagaatcttgaggttgtctggcattatctgagtggactcgaaggaatcacacatgtcctggtaagagtgaggcaggaggataagaaccagagaggaagagctgggaagatgccgtgctcctagccttggcctgaagaaggggccacagggcaaggaggacaggcatctgcagaagctggaaggtgaggaggcaggttttctctcagagcctccaaaggaaccagttcttcaggttgcctcagacttctccagaccattaagataatagatcagtgccggtttgttccagcggccttaaggaagcatttggtaactgacaacctgataaggacaagtgagaggaggtttgcagatgtgagagatgatgaagcatacgggctttccatcccacaccagccactacctcaccccctgggtcagcagcgcaccagcaagtgggctcatttcatttggctgcctccacagaataagaggcggctcatgctgccccattgctttccagttgtctcaaattcccctattgttacagagtcatagtaacaggcgagccacagtcgctctccactggcatccagggatgaccattgtgtaagtctctcagagtgttgaaactgcagaagccattccaggctgggggtggagagccttagctggcacacaggggtgggtgtttctcttttctatcaggcctttggaaccaaaagaacagggtctcacaggactgcttcagaaaggatttctcaccttttctggtatcttgaggattaaatgtatttgaaagacctttgggaattgtagacccaaacataagtattggctcacatcagtttttattagtaagttgaagacaggccctggagatgtaaaatagagaaatggactgtttgcttctttcaaagtggagttttcaacttctgactacacactagaatcccctgggaggggttaaaagaaattctcaaagtctaggtcacaccctggtccaacaaaatgagaatgtctgaggatgagacccaggccctgctttgaattgttgacaaggcctagcctcaaggaataattcatctgtcactggcctcataacttcctgattgcaccagtgaattcctgtaggaaagtagcacactgtgacaacatgcctgaggcaagcaccttagaagggagaaagggcttaggggatttctcacagtaaaaccatgaggacgtggggtctctccagaaggcacgcactttagctgtgcagtgcttgcctataatcttgctacagtgagataggagctagagacaggcgatccctggaagtgttcagggcagctagcctggtgcatagaggggcacacaagagaccctgtctcaaataagatgggaaatggagtatgacacccaggttgtcctctgacttccacatgtatggtatggcatgcacatgtccatactcagatgtacatttgtacacaggtacacacacatgtaccacatgtggagtgagtgagagagagagagagagagagagagagagagagagagagaagacagagacagagacagagacagagaagagggaggagggagagagatttttaacggagaaagttttattttggcttatgacttcagagtctttggcccctggttgctcaaacttttgtggtgtagcaagctgcttagttcatgatggcaagggagcagagaacagaagagaaagatgaggaggtcccaaggtcaatcatgtgccatgaccacagtgacttcacttctctcagggctccacctcttaaaggctctgccacaaatgactttgggggaaaggcagtgtattaacttcttagggttgtcataacgaataatcatcaactaggctgcttggaatgcacaatgtctatctctcttttctgggaactttgagcctaaggctacaggggagcagaaagctttccttacctcttctagaccctgttgcttctgggcctgtgctatagcaccccatctctgcctgattccacacagtttgtcccaccttctctctgttgtagggaaagacacagatcactggatttggagccttcctcagtctagtatggtctcttctcaaccttaactgaccatatctgcaaagactctatttctaaataaggatatattctggggtgtcacatggacacaaatttggggcaaattctatgtaatgattgacagagaggtagacaaatgaaaaaggaagctggggtgaggaagtgaagtagccatgggctctttcccagccaagtacacccagctgggctcccactctgtgggtagtagagaaacaaagggagcaaagattaaaaaaagacaaagccaggagaggcagggaggtgacttagtcacacccccttaggagcccagaggactccagagcagacaaaatgcaaagcaggcagccactgggggaagggtcagcaggaacacactgacccttcccgcctggtgcaagccccttccactcatctgtgctcacacagaattttacagcccacctcggggagaggagctgactagtgggtctaaactgacaatcatggaaggggcctgctctatctccactgtcctggcagacactttgagttaacttggttagagcaacttgtaggattttttttttcttctttaaaaatatacctagattctagaaagaggctggaggaaataataaggaaggtgccttgtttgcctcagcaccaaatgtgagtgggtgggatggggtgggccagtggacagagggtgttttggcttgtctgccctgatcttggctaagctaagctgggtgccaacaaaactgagcattgtcacaccgtggggactgtagttagagtggagactgtggataagcacacagacgctgtatcccttcctctttcagccatcttctccaggatgtctccagtgacagagctttcccttctttatagagtcaaggtgtttgttgtccacagtgggctggctaagtgagaatagcacagctgaggtttctttgaaggtctccaagggggctaggcatcacagatcttctctaagtgtgaaggatgaaaggctggggtcatactagacttacctctcccacacagaaacaccctccctgccctgcggccctaacctgctatggggcctccatggagccttctcactgtggagagtttgcactttctcctgggtaaagttgcagttgttgtggggatgatatgagatgaggtcccttaatgtggctctgggtgtagcacccagtagtgtccatgacacttattgaagttggaaggccatcttccttcaggcagggtcacaatctgagctgaatagacccagtgtggccctttcagtaaagaactcacggtagctgaagaaacagtacccaaaccatcaagtcggtatggaagccatagccctctgcaaagaaactagctttccaaagagcacgtcacatttcaaatgagaatctcatattttaagtagaaatgttcttcttctgccattgttgggcaaattgataaaatactgactggaagactccttctctcatgtttggaggtttttttaaggaggaggggaaacatcataaattccatggagtcatagaggaagcagatttaaaatgatccaaaagagtaaatgccctattattttggggccaatgttgaaagagccaggcttcagatatggtttatgaatctcatattaaaatgcacttagagagagagtgtttgagcccatccttcctggtttcctaattagtcactgattttagtatctttgcgttctcactcacttacaatttaataaaatataaattttcttcttaacagaactcataatgtagagttttcaataaactggagaacttacagtttccttcccagagaactcaccctggacatcctaattaatatccaatcgagatgcttctgtgctaacagtctttagcgtgacaaattagcctggttctgtcttagaaagatatttgtgaggattactaatgagtgtatttcatatgcctaagttcctcccggggagtaatttgggtgttcaggaagtatgttagacaccattttggggattgtggagactatttaatgtcttaactatagcacccatggcctcagagagttagcccatcctgtacatagctcaggtgagtgcctgggaaaaatggagacactggggaaggagcagggaaaccttatgaacagcagccatgtctgcactgatggctgtgaccagaacttgtctagtggcaggaccaatctaagacagcctggtagcttccagcatcgtggcagggctggctcctactgtggatgctgcagagaagaacaggatggaagggaggaccaggcccatcagcttgttcatacactattggttacagcaaatcacaggaaccaggcatgccctcgtgagttataggtagcatgacccagactcagatgtgttaactgacctgcccaaggtcaccttgctcgggctcagacatggcagagatggacagatgcaggtctcctataatcttgtttgcgtttctaccacttttatgaaagaaggaggccacttctgtaagttgaccacaaaggagacccaagccacccgaagcacacactattgtacgatttctttgggatgcttctctatgcaactagaaggttttccttgtgttgctctgcacaaaagtatggacataaatgcttcgtgttgatgttcttcattgcaaggtggagaggctggtggggctgaagggtgaggcagacctgggcccaaaaaattcagagaggcctcgtaagcaatgctgccatctagtgaggcgaacattagcttacctaagaggtggacttagtagaattgggtgaaaatgttttaatttcccaaggagagtgtgaggaaacaaaactctttcatcatcaattgggagaccagggtttgacagggtggcatatgtttaaattgacttttccaacaaaagtcttttggggaaagactttgttgttgcagtcttctgggggaggcagatctgcttaacacagtattctggcttgtttatctatgagctgagcaatatttgctatgcacaggggaatgatatactctggactccccaaaccttttccagcaaatatttaactgagaccctgtctagaaataggaaggggagtggagaggatgctgatattgaaggctcatgtcagagggatcctgctttcaaactccatcaccacacattggagtgggtggtgagggggaagagggagaggaagacacatttctatattatttcataatgatgtaagtttcatgttaggaatcagcttgatccagagtctctggttttgtttggctgaaagcattgggaagcctcgtgcagaatcattcttatttagctgcctagcccttggccttggttttcctctcatttctggctttgtcttgaagcatgcaaccatcatagctgtaagagctactggtctaggattcccttccctcaccactactgatatctctgaaggtaagtcaatgatatgtaaaatagctctctatgaaaatcagttaattttcttatttattaggaacttatatgaaagatttgtcgttgccccccctccccccaaaaaaaggaagccaagcagtctccttactcaaacactgctaatccttttgcttctacaaagcagctgtaaagtaaatgggaaacgagccagcatagcattgagggctaactggtatagagtcaataaatatttcctaaggaatgtaagtttctagtataatccccttgtaaacattatagacaggttgtgcttgaccccaagaccaggaagaaaatctggagcaagggttcaaggagacagagataagagcagatctgtaaacatgggctgtcatcatgagaatggggtgttgggaactggaaaagatgcagagaagaagccggaacacataaaaatagcaaatcatcgactttccctttagtactacatgtaaggctcctggtagctaagtgatgtgaagtggcaggcaggtagctatgactcggtgggttcaggggagcatggcacttgagtagacactgagagggaagaaccaattgtggatttaggagggcaatagtcacagaggcttatgggtattgcagatgtttaagaagaagtcagagaccttgaggattgatcatgggagggacaaggaggagagagatgagaacaagaccccccaggctcatttctgctgagtgttgaaaagactctgagccattcacaaatttagggaggacagaaggcccagaccagtgggcaaagctcatgtgtagacatgtgagctcttgtttattctgggacccttggtctggagacagatgtgtctgagggtctagttaggggtgaggaaggacacaggggagcctaggcatgcaagagaaagttgtaaagatggttctggaattcaggtatccctaggtgggtaagaaaggtcacagagaactctggaaagcatgtcttctggatctgattgttatctgcactgtgtggtcagtcgcctcacaccagtacccacccctaagaagtagtgttggtattctctgaccacaccatataggcttgcacatccatctatccattcagccagcattcattgggtcagttatagtaggaacacaaagtgttgtcttcagatagtgggggtaggcgaacactgcttcaagcgggtcttagtgtgggaaatcagtgctggaagagggaagttctgagtttcgtgtgtgtgtgtgtgtgtgtgtgtgtgtgtgtgtgtgtgtgtgtgtgtttgcgttcataccagtgtcctttcaggaatggcggagttatttcttgctcctagtggtaggcagaaaccgtaacctagactctgcctgattgcagcttgtgggatcaggaatccctgctgcccagctcagttgctcctgtgaagaactctgacccctgatgggatggtttatgctggcctccccttacctccaccccacacttgctgtgtcagcagtaaacacagcaaaggtcatagtgtcctactgacctggctccaggatccccctgcattgtcttcctggaaatgagctccttcttaaagcttatgtattgataagctaggcattgaacaactggggcagctaactgtggtaagctcacttgttacttactctgtcagcctctgatgctgggagaagaaaaatgggtctttctgatactcaaattcctttagtgtttcagactcacaaaataccaggtgttggcatctgggagacacagagataagtcagactgagaccctgtcttcaggagtcttggctcacgaggttctctggtgtgggaccagtgtcaatggacgagcatagttacaatgtcatagagcccggcgtgaattccactgaacaatctggaaaatgggctttagtactggttatctacctgctatgttttaggtgactttgtggatacaagaagtaatcctgaaagaaatcatcactgtagtcttgaaactacagtctccagtcaaggctctagtccacctttaaagctgtgttctgcctcccttatctgtatgcaattggatgactggggatttggcaggagaggcaagcatccaggggaaggtttacaccttctctcttgcccctctcccatctctgacagtctacactgagcatgcccagagtgcttggcttacccaccaactcctaatatgatttcagtttggagggctatgtgcccttcccccagccttgagtaggctagcccacctagggtggagtcttccaacctaggtgaagtctattatcctgccacaccttcagcttcctgcatgaagccactacctgctgagcagctgagcttgtcttcctgacaagatcctggcaaagtgatgagatcctggcaaagaggggaatgggtttccccctttatagtcagaccttagaattaagacattgagccttgatcagagaactttgtcttggctcgttatttctctcgccatccttcccactcccagctttcctttcaggaacctagtaacctgtggccgctggtggctacaggtggcacctaatgtggggtctgaatacagaaagaccaactgtgggacactgttggtggagatccacagaaaacagaagatggtatcctgaacggtggtaaacaacacacagcattaatgttagtgctataactttcatcttttgaaggctgttaattgcaaggctgcaaaaaggatacaggatagactgagtcagcgtcagccgaatgctgatatcagctaggggttaacagtggaaaatgggactggaaaattctaaacaggcatttgcctacagtcaaggactatgtcaggcaagaggagtagggcttaaaataaaataaaataaaatgagtaaaagacaaacaaaaacaacaacaaacaaaaaagggggagattctagatatacaaatgacatgagagggagagagatcaagagagaaggaaaatggatttcagagctctcccagggacagaagaaaatcagaagatgtctctggcccctacaggagacattcttctggttacatcaggttcccttccctctctatattgtctgtccttggtgcaccaatctgcccagatgtcaattttttgtctgtttttgttttgttgtttgaatgactgtttttccatgtttcatgttgaaaagaaagaatagttaaaactttatctgctggctatcaatctcttgattcagtctcagtttgcacagtggaggctgatttaagttgtcccgcacccttagccaggagtcaagcacagcaggtgaggccccgctggaaagctgcttttaaaaggcatctgcagcttcttagttctaaggcaaataagctgatagctgtttttttcctagaaagatctctgcaattgtgattattggtttcagcaaatgacaaagtgatttttctcttaaaattttagctagaaaaagtaaaaattctttgattggtctaaattgataagatttgtgtagctgcttcatttggtttctgactggtcttaaaggtataaatatgctctccatgtcttggtcatagagtattggcttatatgttattgggtatgatttaaaagtgtaacattagtaacaagaaagttagcttaaaactggtaattcagggttggagtcattttaaacaacaacacatggcatgaaccaacccaggcaaccaggcctctaaagctacttctaaattgggataatattttatgtaattcttatcctaaaaactagacttataagggataagattcaaaacaatgtctctttaatgaagcattaaaagttgcactgtcatgcattcatatataagaattggcagccaaactttgtaacgtgaaagtgatgcttttgatattgattttaaagagaatagattgtttgaaattgggttttgttttccgaaatttatggttatgctctaatattgccaaagaaacttaaaaattatggttaaaccgccagtgttccattggctgcattttacatttaaaaatattttcctattggtgtttaaaattaaaatcatacatgtacataatttaaagtgacatcacttgagaaaccttgaggtgcaagacgccccccactgtgaatacagtgggcatctcctgctttctcatgatttcttaaatatttatctcctcagcatcatgcttttctgctgactcttctcgacttgcttagatgtcgatttcttaagactttgtcactaggtttatgatgtcaaagttgttgccatggacttgggggtgtggctccgaggtagaatgcttgtctagcatatacaaagcctctagttacagccccagtaacacaaaaataaacaacagtgacaacaaaacccaacacagcccctctgttttcccagcgaacctagacactgccctttttgctgtgttgacatttgttctgatgctgcagaggaaacagagggtaaacctcctggctttattttattttatatttttagaccatgaatcaaagcagtaattataccagtcaggatattatttatcacacatttggtacatgctctttaacatttgattattctctctctctctctctctctctctctctctctctctctctctctctctgtgtgtgtgtgtatgtgtgtgttagtgatcgcacatgcaggcatgcatgcacatgacccatgatctgcacgtgggggtcagaggtcaagtttcagaaatgagtcttctcattccattctattgatcctgaggattgaactgatgtcttcaagctttgctttaagtgcctttatccactgagccttctcactagccctaggattatcttttgaaagcataattccactgaataatgtcctcaatgaaagaattaagaacattaatttgtccaatctagaaagacccattgacttgcagtatccaggcggcatgggacgattgtctaaagggaatgcatacctacttgccatctttgctagattcctttccttttttcctagaataaatttttgcctgcaagaataccagataggccgggtgtggtggcacgtgcctttaatcccagcactccggaggcagaggcaggcagatttctgactttgaggccagcctggtctacaaagtgagttccaggacagccagggctatacagagaaaccctgtctcgaaaaaccaacccacccacccccccaaaaaagaatatcagacagacaaattttaattgctcaaaactagagattttgaagagggtttcttaaacgggatgaaaggggtttctcaaatgtcctttggaacatttaaaggaaagcaaggaacacgctttggtttgttaatcataaaatgagaaccttcagttgaaagattgaaatttagaaactcgattccaccaccacaagagcccagacacttctcaaccttaaaagctttctctgtgacgattcatggtgatagcaacagatgtgacttattgatgctacatattgtaatgtgccaatctctggaagctgtttataactcaacaagtcactgttgtgcaggcaatccatgtgttagattacagatcttgtaacctaagatccatttgaagggaacataagatcctttgaaatctacaagttttagtacactggagtacttcgtttccttttaaatttatgtatttttatttatgtattaaacaaattaaatgtaaatttatttataatttcttttttattattattatgtgtgggtgcctacttgtctgtgtgtatctcacacgggtgcagtgccctcggaggctagaagagggcatagaatcctctggagtttgagttgctgtcagttctaagatgcccaatctgtgtgctaggagctgaagctgggtcctttacaagagcagcaggtccttttcatggttgagccgtttctcccaaccccaagcacacggtttctcgatacagacccagaacgttcatttcggtaaacctttaagagattggcacttgttgaactttagtgtagcatcaaagaagactgttagtgatgccattaaaggctggtaagatgtttcctcgttttctaagcagttggctggattttcttcaagtatctcaagtgaaatagcacatctggagctaggccacacaacctaagaaccataagcagtcatcaaagaaatgcatgcagttgtgggactagggagacagtatggtgcttgccatgagagccccagggcctggttttgatccttagaaggctggacgggatgttgtgtatttgtaaccttggggcaagaagctgggcttgctggccagctagtctagtctacttggtatggtccttgcctgtgagagaccctgtttcaaaaataaggtggatgtttcctgtggaccccgcccccaccataattattttcattgctacttcataactgaaagtttgctactgttatgaatcataatgtaaatctctgtgttttctgatgatcttaggtggtgcctgagaaagagttgtttgactccccctcccagggggtcgatgcagcccataggttgagaaccactgctatagaccatatattaggataagactgcacttaaccattcggtgttgcttttgtttggaagatctttccgcagtgatgttatcatagctattggtcatttgaacagtatactatgaagtgttagctaggtacactttcgatcacagggcacatcaacttcacagccagtcttttattcccttgaaagctaaaactctgttctctggagtccaagaccactcataaagccaggcatggtgacacatgcctttaatcccagcacttggatctttgtacgttcgaggccagcctggtctacagagtgagtttctggacagtcagggcatacacagagaaacctgtcttgaaacaaaacaaaacactactcctattctacaatgcttgctaatgaactgtgctaatgaaccatacctcaggggttgtttttttggagctaggttgttcagtacctaggttgtcttagtactagtgcctccatttcctgagtgctggggtttacaggtgtgcaccatcaaactcagatacatttgtgcaaggtgctttcttttgtgtgtgaggagctctgggtgtgcagttttctgtgcttatggttatttgatgcatgggatccttcatgtttgcctattgcaaaactgaccactgtcagggcttccttactccaaaaggagaaaaaaaaaccattttgacaatctttgttttgtatcgagacaacacatcttgtgaatccagcagcagatgtatttatttgaggctcctctctcggcattgttttgcttctgatgcgtcaagggcagtaacttgtatgataatcgggcatttctatgcaggcagtgctttagccagctcaatcaaaagggacattcagcaggtctggtccctgccgttctgacaaccggctttaacatgcaccaacatgcattattaattacaaaagcacatcaataaaaacactcgcaagatacaatgcacattagaattatcgaggtgatttttagatggatggtgatgctcaggcccaagaagccgattaaaccaccaaaggttttactaataaaagccagagccgtggcgccaactgtccctaactttcccactggatttccttgctttcaaagctcccttcatgaatggcttcctcagtgtctaaggatcagagatgtgctgggagactgacacaagctgacatttttttttaaaggttgcagaaatccatggcataagttctttgaagagagagtaaaatgtaagaataggttctcattttacaagagcactattttctgtgaaagggacttcagtgtgggctgtgtttgcaaggccacaggggtctggaaggctggtggagggccagggtggtgacgctttctaatctacttctggtcttttagggttcacctcatctttgcttattgatccctggctagagaaggaagtgcacaaaacaaaactttttttttttttagaaagtcttggaattttagtgatttctggtctcgaagtgtcgtaatctcacaggttttttaattattattattagatattttctttatatacatttcaaatttcaaatgctatcgttttaacctaagtgagttctgctcccagtgtataaagtcatcagatggggcctatgctgaggaagaactcggtggtagagcactcgtctggcacttgcttattggcatttttattagctgtaaacagtgatgtctttaaaagcattcttcctttaggtttcatcattgtatctttatttgcatgagggttttgcctgtgtgtttgtccctgtatctatcacgtgtgtgcctggtgcctgtggaggtcagaagggggtgtcagatcatttggaactgaagttatgggtggcttggtgcaccatgggagagctgagaaacaagcccaggtcctctgtaagaatgagctctccgcgaccaagccattgcttctgttccatgaatcttagatatgtgatgttcagtatggtggccaatagccatatgtagttactgacatctgaagtggggctggctagtcaaaagggctctgtgccataagtgatgaccacttttcaggtttcagagacttactccctggaaaagttttattggttttgcttttaaatatgattataatattgaatgtacattggatatcatgggtgagagataaggtcactgaagtgaatttcatctcttcctttgtgcttttaaatctggttactgctgtccaacagagcagcaaatgcatttgtggtacctctgtctttctgttggagagctccactctaggacaaaggaacatttaatgcagaagaagtttgtaccgcacagttttgactgaaggatggacaggacagctagcgaccgattttgatggttgttggattctggttccattaaggcccccttaatcaaacttcttgtcaatttacccctaatctttgattggaaggatcactgaatatgttttatttgcctaaaacagcacatttgtgacagatgtgtagcctggtcttcctgttggtcctctaacaagtggagtgagggctgcctctgactctgttgcctgccattaggtcctcctttctttaatcgactgcctggtagggcctcagtgggaaagaatgtgcttagtcctgctgggacttaatatcccagggtggtatggtacccaagggggcataccctcctctgagaaggggaggggatttttaagggtgggactggggctgcgatcagaggtaaagtgaaaacataaattaattaatgaaaaaaataataaaaatcaggacaactccatcttcatttcaaaactgacttacttttaatagcatttgtgcaaaaacattctatttacgtggatgggaggcctgattcacagagttcttaggaggctaacgaattgtgaaaattatccagaaacttgtgaaagaacctgtctggtcccatggagaggcatgcagggggacttaagggcccttagaagtctcagaccagctatctgcctctgtgttcacaccttccttccaataaatgaagccattggggaagataaaatatttattcctaagtgtctataactgaatttatgactataacttgctggatattattgcctgtgtaaacccatgtaactgtgcacgtaaaacatgtttttattagttcctacataaaaattttatgataatggtgaacaaaggagcaatttagtttagcagagtttgttcttattactctggcttccaatagactagctacagtgcaaacagcagcagtctgcaggggagaggggcggagctcgctgggctcatgctcctggcagtgggctgggaaggtggggaggcctcagaggggtgaggatggggagggtagccattaaatctctgcaggttgttgttgggcagccccactcctcattcgtagctgtgcagcattcagatttggcctctgaaaaggcttcataactgccactgaaagaactcccacatactgtatttcaaccagagaattacagagagaaaagggttcaagtggcttattgtgggtcatctcccactctgggatttaaacaaagcgcacacagaacaaagttcctttagctctggtgccttcatctgagtctcccctgtctgcaggacttggcaggctttctggacggagagcccacgcctctcattcccactaccgtcctttcatgcttgacccctcgaatgtggcaaaggatccctgtggtgacctggattggagggaggttcctctagaatttgaaaataaagcatcctccataaacacagccagttccttcctaatgacgagttgaaaatcgctcgtgcataatctaggtgaacacagttcctgcactgacatttagggacaggatttgacatgtgaaaatggacttggtaatagcaagatgtattttaaattgcatgaacttcggaatgaaagacaaaggattattgtaggcatataatgctgcaggctaccctagaaatggacggagaaactgggccagcgtggtgcgtgctgagttcattgtgggataagctctctctgaagcattaagttgaaggacagcccagtccctagagactgtgatgggctagactctagacatcggaagttcttaaacgttggaactctcatggtcaagatctagagatgcagcttagtcagtagggtgcttgcctagaatgtagagacccttgtattcagtacccagcatcacaaagcatggtggtgacacacacctgcaatccaagcacatggatgctagaggcaggattatcagagattaagggctatttggggatgtgtgtgtgtgtgtgtgtgtgtgtgtgagagagagagagagagagagagagagagagagagagagacagccagtaagtacacaccttgctcacaagcatgaggacctgagtttgtccccctagaacttacattagaaacaaaaccagtctatcaggttgtacacttgaaatcccagttctggataggccgaggcaggcagaaccctagggcttgcctgcctgcctgccagtctaacttacttggtaagctccaggcccgtgagagaccctatctcaaacaaacctacaaaagcaaagtgggtggctcctgaggagtgacatccaaggctgtcctctgtttctatatgcatgtccacaactctcatgtatacaagcttgcatgtgtacacaagcaaacgcatacacacaagacaacactgtcaactcacagttgaggagcacctggttcatctccctattttggtaggtgcaagtagcatcgttgtagacagatggctacatgtcctgttctcagaagtatatagagagggcagcgattctcaagcatcctaatgctgtgatcctttaatatagttcctcatgttgtggtgaccccaaacacaaaattatttttattgctacttcataactgtaattttgcttctgttataaaccataatgtaaatacctgttttccaatggtcttggtgaccctggtgaaagggggttgagcatcactgttgtgcggggagagtctacatcacctgcacagtaattgagagactgggtttccttgaagagctagtctattaggtcctttactctctatgttcccatagtagacctgtttactgactctcagatgtgtctttgtgtattttagatatatttcttagtgtccatttccccttgtcaaggacttatgtcctgcacaaagaatatcttaggtatgctcatgtgtgtgcatgtatagatgtgtacgtgtgtgtgcatcatgtgcatgcacctctttgctttgatttcattttttttttttgctgtagtcaaaacttgctaaatctttaactataaaatggacacacctgttgatttattcttgcccaatttctgtgattctgttagtgataagccttctagaaatttaaacagctcagttttcaattcttttgtcaagaagactgtttaaggtaataaagcttactccactaggttcatggacatgaccttccaaagtgaagaaattgctgtccactggggaaaggttactacaagtgggagtatctttgtctgttctgaaaatcgtagcttttggcacgggtttctttctgagatggcctggttgattccaggccttggatgtaggaactgagacctatttgtatgattaccccacatatatggaaacagcacagcctctacaattgctttctgttgaggatacggtcatggtttgtaggttggcatgggagtgagatgataggtttagttgagatattgttgctctcttagaaaagattattaaagaaataactgtttggggtcaactccagcaagactgagtttcaaatgcagtgtagtcttttaactgaggcgcggatgaatagcttttcaagtgtgtatgaaaggcaagaatccctaaagatcagctgttttaaatagcacactccagggacccaaggcttataacaaaagggtagatatggcagagatgaacccccaggtccagctctgagaatcaagtgtgctggctgggctccctgaggtgttggggaatgccaatcttgttggctctggttggttagctaggggagtctagttagatatggccacaatgtcagttggtgttgactctgacccacatacaagtggaaaacacagctgagcttgggaaaaaccatagtatacaaaatacgacaaaaaaagttacgtcttcaatgaacaggggcgaaatctgagcagaactctctaacgaaaaatccgggacactagatggaatattacagccatgatggaaaaagcagagtatttaaaaatacaacaagattagacacatttctagtcctggcttaccacacagaaaacctctttgataattttatgtggacaggagaatttgacatattagataaatttgaataaatctgaaaaagaaaaaaattaactttggaattttgttttacaagtcatgaggtccaggatttaaaaaaaaatgtttaaaaactgtattttagtgttctctatgagaatttgtaattacggaagtagagagagtatttgggcattactcaagttccaaagcgttctcaatgttacttttctcagagaaggggagggcgatgacacatataagcatatttagttaataagctaggcctgttagatggaccagtttagaaagcatcggaggccaaaggtcgtgggttcagtaacaagattaagatctgcttgattagggtcagcggccgggagcttcacagcagacaacgctgtgactgtgacatgctgtccctgacttgtaggaatggtgtgacagatacagcaagtgaccctaaactcagaggggaagagactgatccccaaactgtcagagagtgccatgagctcagccctccagctggccattttgtgtgtaggtttgtggggggaagggttagcagattggttttgagtcttaagccatttttgagaataaagatatctgagggtccctctagccaaatattccttctggcgtacctctgatttgaaccattaggatgtggcgaggttaactgactgtaatgaggtcctgcagctggaactttgtgtacaactgaaccctggcttttaaagctcacccatagacaatgttcgcttttctctgtgtatgccagagatcttcaattagttttgagctctgctctcttatgacagatttcttgacaggtgtcaatagacatataaaacttggtctagtatataagagcttttctggctcttttttttttttgattgtgcagaattttccatttcttcagttggtaaacagaaaatatgagatgaagtcaaaaccggaaccacgtagggcagtgcatcatgggtcagtcagctgaccacacgtcagtccttgttcacccgagtggtttcagtgctagtgggtaatgttattgctgttgtctcttcacaggcgtgttcataaggtttcacataaaggccactgaaaggctgagtaaggataaacttaaggatgtcattatatttttaaatgttctcgctttgtgtttcattatggcttagaccacagggcacactcagccatgttctgtcatttcattccagatataccagctcccctcactggggaaactgggctagattaggaaactgatttattcaaagcttccaattttgttccaactgagccagccccacaatagttcttcttagtccgtacagcattaactgagggtccagtgcctgccacacccttttccagacactgggatgacaataccaattccattcggtccagcctgcctctggcttgtttctggctatgatttatgctgttgtggtttctgtatctagtctccagcaactgcatgcctcatccctgcatcttctatgagctcttctctcctttctaccattttgaagagcgctcatatactcatgcatgcatgcatgcctgacattgtttcctcacttgtgcagactgcaaagttgtttttgaattgagcttgctgaccatttttcaggctacggtgggttacttacaactgagtattgtctatcctaaaaaactgtttagctctctctctctctctctctctctctctctctctctctctttctctctctctctctctctgacactgtgtgtgtgcacgcgtgtgtgcgagtgtgtatgtgtgcatgcgtgcgtgcctgttgaagttcaaggaaatgtaaggaagtaggctgctcttcagttccagctcatgatgcaccgttgctctcttgcaacaagcattgctcagatatagacaaagagcagtgacagactctggaagtcttagagatacatcctgatgacctctacagacaagaaaacatggccgattaaacataaatggaaaaggccatgatctgtattagaattaaatgctactgcagttccagctaatctaatgtgtagtctcttaatgtcgttatatgtaccctcggcagcatcactaacaaacacagccattttgcaagagttacatagggccagtattcagacatttagatctgtccagcctttgtcttccaagcctagggttattttttaggcaggagaacaacagctcagtttgtgaaatgggtctctggttttctgtgcttgtgagtcttctagtactacacggctctgagttaaactaaaaagcatgttttctggaaggaaaactgaggcagggcagtgagaatggcctctgacctgatttctcctctcctggcttctgagttcttatggtccttgatcccattttctgagacttcctgctctagctgtggctgcagccagccagcaccaagctgacagagggacacactctccctgcttcattttccaccccttatgcaaatttttattgtttgtctcttgctcagaatctatcatctcaaggatagagactgaccaaggccaatggcattcgttgctccagcgttttcccatgcggcagagttgatacccttgtcgataacagtggtgttgacaggattaaacatggtgcttttaggctggattgagatctcagcagttaggaccactggctgctttctcagaggacccaggttcaactcccagcatccacatggagctcatcattgtagctcacgttccagagatctctggaattccctcttttagactctataggcactgtgtggtgcacagacatatatggaggcatacaataattagcacacacataaaataatttaaaacaaagctgaatataccacttttttaccaccattgccaagccacactcatggtgatgatggtgcttctaaggatacctgatgccctctttccaagcctactagactcctcatcttatatgacgctaataaatcactgagacacatgattggaggttctccattaaagcattgtgatttagcatgcctgcaaagatgaactaacgtatgcctgagatagctctgtctcgatggtcttgtcctttgtcttaaggaataccgaatggcagagaagcacctgaaaaaatgctcaacatccttaatcatcagggaaatgcaaatcaaaacaaccctgagattccacctcacaccagtcagaatggctaagatcaaaaattcaggtgacagcagatgctggcgtggatgtggagaaagaggaacactcctccattgttggtgggattgcaggcttgtacaaccactatggaaatcagtctggcggttcctcagaaaactggatatagtactaccggaggatccagcaatacctctcctgggcatatatccagaagatgccccaactggtaagaaggacacatgctccactatgttcatagcagccttatttataatagccagaagctggaaggaacccagatgcccctcaacagaggaatggatacagaaaatgtggtacatctacacaatggagtactactcagctattaaaaagaatgaatttatgaaattcctagccaaatggatcgacctggagggcatcatcctgagtgaggtaacacattcacaaaggaactcacacaatatgtactcactgataagtggatattagcccaaaacctaagatacccaagatataagatacaatttcctaaacacatgaaactcaagaaaaatgaagactgaagtgtgaacactatgcccctccttagaagagggaacaaaacacccttggaaggagttacagagacaaagtttggagctgagataaaaggatggaccatgtagacactagcatatccggggatccatcccataatcagcttccaaatgctgacaccattgcatacactagcaagattatgctgaaaggaccctgatatagctgtctcttgtcagagtatgcctgggcctagcaaacatagaagtggatgctcacagtcggctattggatggatcacatggcccccaatgaaggagctagagaaagtaccaaagaagctaaagggatctgcaaccctataggtggaacaacattatgaactaaccagtaccccggagctcttgactctagctgcatatgcatcaaaagatggcctagtcggccatcactggaaagagaggcccattggacacgcaaactttatatgccccagtacaggggaacgccagggccataaaaggggagtgggtgggtaggggagagggggtgggtggctatgggggacttttggtatagcattgcaaatgtaaatgagcgaaatacctaataaaaaatggaaaaaaaaaaaaaaagagtcctttggaaaggcactgaactccggtgtcttagccggcacatgttgggagtatgaaatttaagagaagattccaaactagcagcacagctggccctgtgctttatcgtgctccccgggggtccttcaggaagcaggcaggtggccctgcccctttaccttctggcaacacaaagaataaaagtaaacagttcccaggtgctgaggggccagatgtaagccctgataacggctatcatgacttgagcctcctcctccgtttgcagagtctccccacacagagaagactgtgaaggaggtaaggctataaattaagggaaagaaaaagctgccctcgtagacttcgtgtagactcccgttgtggaattctctgttgcaagaggtcactgagtcatatgctgtggatggataattttatggccactaataaaatttatagccaaagcaagctaagataataagggtaatcaaaatgtccagccctgggatgggagattcccatcttggcctgccggggtggctgggcactggccagcacaaggaggaacttatctgtgggactcaaggccaccggaatcctagaggtgatttgtgtgcattggagcctcggagacagggccaggcatgaggcacgcttcaaatgaggtattgagtgattgtgttctgtggacagcattctataaacattaagaaatgaattgctatatttaaatgccctgaagtgaaccctaagcctaagaaatgacctgacccagctgagtttaggaccctacattctgagaagaatgttatctgagcacccaggagtactggtgagggataagggatggagaggagggtgatatttgtcttatgtatgtggaaggagtctgacaattttaatgagacagctaagttgagaggccttttccaccctgagccctcagcctgattcccttcccacctatttccccccactaagggctcagactggacataactcctgcaggctttaggcatgagctagaagggggtggggggagagaatcgtgttactttttcaatctcaccatcctataaaacatgacatggttgtgcagagacacatcagattcactggagggcagaacccctgtgttcttggctaccttctttgactctggtccacacatggtagcccatatgaccatcttcattgaatgagagagagcaaggcgtggtccctgggggaggtcaaaaggaatggactgtttggctttatgggatgttttttattgtgataaaatagccatttgccaaaaatttttaaaaaaagtagcatctgaactactttctagtccatatcaagtgtgcaccgtgtggccatcactgtgcagccttccctgacacctgtctgtagtgttcctcatccaagatggaaattatgaagccagaagacactaactccattcctctcgccttagttcctggcatccccactctccctcctgccactataactgactagataactagggtgcagaaaagagcacaaagcgtttctcacagactgtggaaggcttagatgaccatgcatgctaccacagtacctaactcctggaggtagatgcctttctgacccccatggtcagctgtctgctgtccagagcctacccgggagtctatccatatctgttcagtgttgctcatctttgggttaaggctgctgtttgatctgctcaatggcaagttcattcccctactctagactccattatagcttgtttaatcccagctacttctagtggttgaaaccctgagcagtaaccacacaggaatgtccaggccataccagtgtgcaaatgagctgtaacccatctgcatcgagacggatgtgagctgatttgtgctaactctgatcaagagtatgtattgagcaactctatgtattgacaactataagtaacaaatagcaacaaaaggcactgttgcaaaatagccaggtactgattaagagaaagtgttattagatgctattttctggggcttgggagggggctatcatgtcgttaaatgtagttaaccgaagactgaataggaagaaattgatgcctgaacctccacatacagaatagatgttgtttggaactccctgatgtcttgacgtcagggtcaagacttctgggtcattcttgacattctgggtgaagaatgctatctaagataaactccatgcggatgcccactgatatctctgagcaattctttcagggggaaaagttaaggccagtagcttacagatcctttgttctgattgtgtgctcaagaacataagccagtttaagaggctggatgtctttgggggacacgtactaggtaccttgtgctgagacatatcagtatcaaaattccagtgtgatttaaagacatgtgcctatgcctaggtcaacatagaggggaacaatgtgtggcctgtgcaaagcatcctcacaggacagtcatggcacatggattcttacctttaggaggacctgacacacacacacacacagacacacacacacacacacacacacacgagtgcgcacacacacacacgcacatgcacgcacacacactcacacacacacacacactcatgcatacacacacactcacacgcacacacacacgcacacacactcggttacatgcatcctctcctcatattcctcagtcgtttctctctctctctctctctgtcactctgtgtctcacttctaccaccctctccttctccccgtggaaaatggtggtgtttgaaaagtagaaaactctattaagcagtgacatggtcccatgtaactgagctggagagctaaatgtgggttttaatcagaaccaacccaaacatgacccgtgatgaaaaaccggttcccctggactttcagcttactttaggaactatggtgcagacagtgaaggttttctaccagattgcaggtttcgatgggaaacagccattttgtggctttggatctgagttttctcaggaacaatcatgtattttccacactgtggtgagaaaagaaatacatatgagacagtctgcaaaatcaaggtatatggagtctttcaaatcaggcatctggtccagcactgggcggtgatgctaaggcatcaggatattctttatggatgaaacagtactgtgggggatctaggggggtagggctggggggcagagctgagggtggggaaatctggagtaagttagaccagggggggaatgcaataagaaactgcactgtggtcccaggctgggtttctttacttcctacctgctttccccaggggagcactaacctctctgaccttccatttccttcttggtgatatgggtacattgtcttaggattcagtttctggacgaccctcaggactgtagtgagggcttgcagccaaccaccactacccattcatctgatccccacctgacctggacattctaggcagggctgctggacagaggtgggggagggacaggtccccaggccttagggctgtagtagctaaggctatactgaagacgcacacaacaacagccttggatatagtagcaggagaggggccctcactacaggtggcaggtcctgttagctgggaggaatgaccactgctctgacacaaactcagaagccaggagcaggatgactgcttacaaaacacaggttcctcaggaacaccatggggtgtctctgtggagatagaaggagcaggggatcctcactgatggctgatgggtaagaggacagaagccaggggtcacaggggctccttcctccagaagcatgttagaaatgacctaacctcctctgggcctggtgttgcactgttcagcctacagcaggaaaacagtggctctctcccatgcccaggcctttatttcacctggagatttgtctgagagcacatctggaagcctctctattagcacattatagatagtgtatgacacacacacatgcaccttcacaacacacacatgcatacacactctcataacacacacatgcactgtctctcacacacactcacacatacacacattctcataacatatacacacactcatatacacacacgcccatacacactcacacatgcacacccatgcactcatacacatattcacacatactctcataacacacacatgcattctctctcacacatactcacacatgcacacatattcataacacacacatacactcacactcaatgcacacacactcacacatacgcacatgcacatatatgcactcacacacatatactcacacatatacacatacactcacacacacacatgcacacatacacatacacacaaacatcacatatgtgtgtgcctttattctgagacaggatatgttctaggtttgttacatgtttctaatctatgtccagttttctggtttgcttctttcccgtgaagtgatacacatagcacagtttactttctgtgagccctcaaatctactcgatcctcagcttgttcaacacacgttggtaaccagatggactgaggaaggaaaatagaatggcttcagggcctgcattttctccatgccgtgtgaccttgttcgcatcatgtatctccttcatagctctttcctcatctgcgagctgggagcaagagccaagcctcctagatagctttgtgttgcccatctcccatgggccttgggggagggatagggcttatcagtcttagagggttacgttagataatggtgatacgtttagtatcttcagcctttctgtttaacatgtgtgcagctctgggatgggctacctccagtttagagctgaataaggaatttgtgttggacagatctttcctaactgggtcttgtcagtgggcaagtatttgtccctttgactcctgaggtaattcattcgtgactgatggtattgtatagtgataattgccaaggttgaagggagtagttcttgacagttagtgacttggggacatacaagatagctcattggtgagaagttatcagcggagccccagcactgggagcctgccttctagtacagggtgggtgagtgctggctcatctgataagcagactcctttctcataatcatttggaaacaatatgattttgattgttgagttaaaacaaccacagcttcggagagggtgcctggctcctctgaccttcagagtgataaagatgtagctggacaggtcccagaagttgaacacagccagctcccccttttactgtcagtgcagcatactgtcagctggggatgcctgtacaagttgtaaagaaagtaaatattgaagacacctgagacctgaagatgtttttgcatgtgtgtctgccgaagtacctcacgcagttaagcaccgagaacaacggaagggactcagtggaagagcgcttgccggtgcacacgcaggcatgcccagcaaaataatgagatctggaaaagaaatatatttgcttgtttaaaggactgtagatgtgagcagcagaaaataaaatagtctggatccatgtcacaaatgtgcttttgttatctctgtgtggttgtgttgatcttggtatacagtggacaagacagccctggttcactatcatgtgatatataacttgctgagcataacccaaagtctagacatggaggcaccatttaaagatttgaaagacacaaaatacatttaaaacgaaatacagcaaagggaaaggaaacattcacagaggattgggtgaaggctactcagtgatgccaccatggtgtgcaaggtgtcactgatgccacactcacttgctgacttctctcagatgtcactgtgagtgaaaaccaggtgtgtgccttcaaggtggctttggatggaaatgaggtgttgtggatttgcgagtttggttttagtcctgggtgttgtccaggagagcataaggcaccatctgtggctttagcattactaggtagtggggacaacagtgtgtgtggcagtcccttcaattgtcccctttgggatggtggcagctgttggtggtataggtagctcatagaggtaacctgtgcctaggaagagatagtagcccccatggaatacagggacaccatcctccaggccttctctgtgctgcctcctctccagctgctgtgatggggtcacatttgtttctaatgtgcagaatgaaagtaagaaagtataggttggcagaatctccactgaatgatgccgaacttcccaagttacagcaggagtttaagcaaagtttcgattcaacagtatgcaatggagcaaatggctgctctgctaaaactgagacgtataaatggttttacgtccctggtgttagcccaggctccctcatctgcctcatggccagctaccttgctcagtgaccaaggagaaaggctcctgccctgggttttattacacccgtgttttataaatgataggcatattttccacttatcatttaagagtagcagaccaaagatctttttggtttacctgaagtcatccatctttttgtttgtttatttcaactaatgtgttcccttttggacgtagattaaagttttaaagtaaccacctagcccactttagacttttatcccataaaacaccgtattatgtcagatcaacattagtgtgtctccataccacatcctcattttcccctgaagtgtgggtcttatagcagatgggagatatacagaatagactatctacgtggacttccgttacaagaacaatcacaagaaataaaaaggagacagtcttggttacacagtgagtctaaaggcagcgtatgctgcaagagaccagttctcaaacaaacaaaaatgaaaacactgtgtgttctagattttttttaatcttggtgtgataaaatgccccaacagagtcacttaaggagggtaggaaaggtttatttcaccacataactccaggttatcatccatcctagcagggaagttaaggtagccaggacttgaaacagccagtcacagcccagcccagtcatggatgcatgcacacccgtctcattgctcagttcacagttctcactcttatacagttggccccagcctatgaaacgtcacctacattcagggtgggtctccccacatcagttaacccaattaagaaaagtccccaacaggcatgatgtccataggccaacctgatctaagcaacagggtatactaagttggcagttaaaaccaaccatcataccagacgaatactttaggtaggtgtgaaggcccattcctgctgttccagctcttgggaggtccaaagggaggatcaagaattcaaggctagtcctgctacatacctagttctaggctagcttggactataagaaaccctgcctcaaaacaaacaacaaacaaacaaacaaacctaaaaataaccaagtaaccaaaacaacaacagcaaaaccaaaacaaacacaaagaaacaaagcagaaatcactcatggtcctgttaatggatcagaaggaaaatgaagtctaaaatgttttaagccctttgtgaaaaaccattggtgctgcaaggtagctgtgtctgtttttatctgcatctgcagtccacctgtcttcctacagcagaccctaaccactgttcccaagaaccctttatctgagtcccgtgttcttcattagcaggcttgcttgtgccttcagactggatctctgcctgttccccactttgcaagcactcgaagcccttcccggtgtgaagccagcattagttcatgtcacagttctgaccctgggctatgaagagcatgtagctaacaggtgacactttctcctctccaggaaggggagatgcaggtgtaatacagcctataatgtcaggggttatttcactacattattttaaatggaaacaggaagtgacctagctagcatgctgggaaatggtcacagaaaccccgtgtgcccccagataactgatggtgggtgggattaaacccaccctcttctctagacagcaacctgctggcaatgggcaggcattctgtgagccacaggtaatgagcttcatgtcattttctttgtcagatctcccagctgatgacagagaccggccgcgagggactgacagagtcagcgctcaaccgctacaatgctgacaagcctgcagccagcagtgtcccagccccacagggttcctgtgtggccagtgagacttccacagggacctcagtggccgcttccttcttcgcacggtaagagatgctcagaactttggttcttttcagtacatccagctggcgtgcatcctatgtggaccagatcagctggaaccattagaaggcattcaataccgttctttgagttggctttttgaaagcaagatttccaaactgggcactgttgtcattgtgagccagtgaactctgtgttgaggggactgtcctatgcattatagtgtgtttagcaggatctttggcctctttctactccatgcccatgaacccttctccctaccatgtcctgaaataaccagaggtgtcctggattgagaaccactgttataagaacatatggctctaaagatggccctccttggggtaagactgtaataggtgaagtcctgtggctgctgatcccatacttacctgctcatgaatctgcccccaaaaaagatactattaaagagatgttaggtgtattccttcttgacacactactggatatatagctaatcaaacactggatataaggctaatcttagagagtttaaagccaggagaaccaaaaatgaaaggtatttgaactatgttgccagtctaattttagcaacaaggcagagacagggcaggagacaaaggacagctgagtgggacagcagggttgtccaattcaatctcatgattttatggacaaggacactgaagagcgggaaggtttgtcagagttaactcataacagagacagaaatagcagggggttgatatgtctggtctcctgctcacaattcactgttcactcgatacttgagctaaaccttagaaaatcctctctaaggttctcaggctccagagtaaacaggattctgaataaataacacagagtatgaagccagagggtctggtttgaagattaaaattaggtgatgttaaattattaagaacattacagaagtttaatttcatatgggtctggccagtattttgtgtggctttccttttccctaggaacagaggcattcaggacacaaatgtaagaaggagctctgactgaggaagggaacaagccagagtaggaagagagagacagggtcctgggagaaatgccatctatagtaggtgtcaggaaagggtgttgggagcccagctctgagaggctcagtctggagcacccccccccccccggggctatctgggaacaacagcgaacttgctgcctgtttccatcacttagagagtgaggtttctgtcagcgaggggggtggaaggtgtgctgagtggctacctggtctccatgctggagggggcgagcctggcctccatgctggaggggacaagcttttgacactctttggagttgaactctcacctcctaccctgatgctcttctgagtgtgtgtcagaggattccacacaaaactgccagacactcaaagaaaacaaaacactgaagatagattggactgtggagaaagtaaggggctgggacttctggtggattctatttagggagaataggtgctgggcacctatgatgaacgggccagtgacaatggctgggagctctgtagatgatgataacagtgagcaaagactccaaaagattgctcattaccttgtctgtctgtctgtctatctgtctatctattcatctgtccatccatctatctatctatctatccatccacccatccatccatccatccatccatccatccatccatccatccatccatccatccatccctgtgtatgcatgtacatgcatgtgcatatagatcagaggataacttgtaggagttggttcctttcttccactataggggttcagggattgaactcaggttatcaggcttggtgaaagcagctaatgctcagactgctccccctggcccccttaatatctcttctgctgtgaatcctgatagcacatggagcttaatggtatgagcttaccttcacagggcttatagtgtacagaaggacagcgcaccatggaaaaagcacatgagcacactcttcgctcattccttacccgtcaccctggctcgccattgggttttgcttccttccagcaagtaaggatgcatattaacaacttgtcagtcatgggctggcacctacagcagagagagagatctattcgatagtgagagacataaccagggatctatcacttctttgggtctcagaggtctgtgaagaagtgtttatacgttcctgtagatcgttcacagtaactcgaggcccgttatcttagtctgctcatgttcatgtaacaccatgttcaagactgggtggtttataaagaacaacagattatttctttccttctagagatgggaaattcaagaccagggtactggtgcctatgtaagggctgctgtctgcttccaatgtggcgtcttgtcttcatgaggtggaagacagaagggcaagagagaccaggcttttctgagtggccttctgaaggttcagccttgtaagatcaaggcagtgatgatcaagcttcaacatgagttttggaggggacacattcaaaccattgtgattgttgaatctaagaataaaaaaaaaatattttctttctttagatagtaaacctcttagtggttacctatatttcagaattctagtctaccgttctttcagggaaagaaactttaaaaataataaaagttcaggctgtgagtgtaccttgtttgatagggtgttcacttagcttgtgtgaagctcaggagtggatcttcagcacaacataaatagggcatggagtgatagcagtagaactaaagaagaaactggtacctctgctctcaaatcggttagtaatgcattgctactgagcatgaaggccatttcaagtgtgtgaatcctttagcataaatcttacatcactgagaagagatgatgtggtagatagtatatggttagatttccccttgcgctgacttctcgctaattacatactttgctttctatcataaaaagtacacaaaacccaatggaggagaccctgtcattgaaggttgagacaatggaaatttcactgttatttgaaaagcaatgagtagatactgtatcatgcgtggagttgcctcaaaccttggaaaagaaaatgaatccttcagatggcctcatagcttcacactgagttttcaattcccaaataatccaaaaaagcatcaacaactatggagttgttttcccttcagtctgtctccttcctgtccccgtccttaaactcaatgactttccatttgaagatccagttgcactatttttttttcttgttgattaaaaatgtctgtcctgggtttgaattttctggataaactctagtgttcaatagagcattgctctctgtggttactaatcttggttgtcaacttgattggattgtgaaggtcagtagaacccacttgctggaattcacagagagtctgatgatataatgagggaaaaggaaggaggggagactgacttggaagaagctgataccgtggccacgtctttgcaggctgtatgccatctgggctcctttcccctctacccacagcttcctgtccaccagtaattgaagatcgtatacacactgccactgtcatgttctgtcaagagtacagggcaaagtctccatggattgagccctctgaaatgtgagctgagataaatcacgcctcccttgagtggcagaggattttggtcccaataagtaactgccttaggttcattttgtgggatccaagtgctttctcacttgccatccatcctgacctgttatttcataaggttgctgtcatgcccatgatgtcctctcatcagcctcccacagggccaggtcttagtgtcacatatgaatacacatcattcctctcaccttttgtcttcgttccaaatttatatttttcctagggtcattactaatgctggctctgtctaatcctcccctgttagcccttctatttttgtcttaggtggctcctctgttgcctaacagtttgatcaaattctcttgaacttgtacctggctgttatatgactgatttggccagtagtacctgaagctggagattgccattgtagtaaaccaggtctcagggtcaagggtaaactgatttttaggggactgactcctgatgtcactgctgtcaggaccatgtttcctctctgctcaatccccagtggactacatgcagccatagttacaacggtcctcaatcttattgctattatatataccattttgctgatagccaaataaaaatagctcctggttacactggccccagcaaaggatttgcacatctgatcttggataaaggaggctttcttccatccctgggtactttacacataatagtgatacctggctgtgtgctctgagtttattaagcacaagaaggatgaggaagatcatgagactgcccatagttggtccccttgttctccatcaggcatagttccctgcagggacagttgtgaaacacatcaacaaccattactgggaaaagccacctgaataccacaattggtctcaggagatgcaggagtagaaaaatggagccaggtacacacaagattcatctctcaattgctgacctatgctgtagagatagggcttcatttctgcctctggtgttactgaccagagtagctaatgtccaggattgcattttttattagatttatacctcaaaagatttaaaaaaaaaagcatcccaagacctaaaaccatacaagcaagagctgtgtaagaacctttatgagctcatattgtagaaattttctgttgttaaaattttctgttattgttttcccagttccttgtggtttccatagcagcatgatacctaccttgcctgctgactctggcagctctccttcctatgcactgtccctgccactcttccatctcgttcacttccctctactcctgactattctgcagcttcccatggaagcagggccacttaggagctccctgtgagacactggggaaagccaatgtgcacagttgtgtcacggaacagggcacccaattgtgaatgggctttaagggctaaagcactgtaggctcatggggagactctggcaagcctccagtaggggcatctttttcctaactacctgcaagtgtggcctgggctccagatgctccaatcatccagtccccttctttggcagctaatcagagccaggcaaggatcactgaaggccaaaccatcaccccatggatctctggcttatgtattcctggcaggcttaggtttactctccttagaaaaggttctgagcacttattggaaaagaaagaagtgttgctcatgaatatggatgaggtgaacttctaggagtcctggttgtatgaatatagttccacttaaactcacctcagtggcagtgtgaaaggaagactttaggaaggagccaagtgagtttctagtgcccttggatttctgaggccccaggaaacagtatcaggtgtagcttgcactaagaaatcttccccccccctgccctgattgccctgagagatggcaaaagcattgcaaacaagtagctgcatttagtgtctccactgtggagccctgtgttcaatggaatccgaagggctggagtgttggatcagtgattaagagcgtttgttgctctaccagggaacctgggtttgagtctctgcatctatataatggctcacaactctgttgctccagtcttaggggatccaatgccctcttctgacgttgggagtaacagacacaaatgtacacagacgtacacctcagaaaggaagtcatctgtacagggagtgcagaccagcagctttcaaaatccaaagggagtcagagccctttggcaatgagctcaccaaagactggctgagagaggagcatgtttgaagccatatacccatggcttcagttagtctaatacataactctaaattttcaaagtgtttttttttttcatatgttgattgagacagggtcttagtttgaggctcaggttaattttgaacttactacgcagttcaggctgactttgaacttagtatctgcctctctctactttctaagtgtatctatccattataattgtccattgccatgcctggctttgtaagtgtttcatttcttaggttttatatgcctgtctcccctgcctagcaccgggaggacaactgagcgccaccatacctgggtttacatgtgggttctaagggggcagagctcaagtgcccatgtttgcatgtaagatgagcggcatcctcagtaccaaccccaacccctgtcccagatgtttattttataatccagaaaagttcctcgataataaaggatagtaggtaggaaggaggaacatttaagaattctgtcaccactggctcttgggaggttgaagagggaggatcagaagtttaaggccaaccttagctatacatttcaagttcaaggctccatgactgcggagaaaggaattctgttaccctagagctcagctgagagtcattccacaaaggccacaaatcaaaattgtcatagcattgaccttgaaaatcaaccaaagcattaagttaaatcaaagtgaaagatggaaggtactcttttgcttgtggattgactttgggggtgacatacggcaggctgtaaaggaatgaatttggaggtgacacatggtagtctgaaaaggagtggaagcaatggtcaagtatataggagaggaagagggatgagggggaggtggagctctgttaccatcccgctacagcatgcttgcaactagttttcaatcatccacatttactcatctggaaatcatagcagcttccatggtctgaggcatccccaagttttacatcatcttcgtcatcacatctttagcttcaaaagtccccatcagttggttctaaaaccacaccatcacaggcacggaaaccattgcacagaatggtgaggtaagttggccaaggtcacacaaggtcacacagctagtgtgtggggtgtgagcccggagcctctgaaccagaatgttggctccaaaatgcagagacagtagttgcctctgctcttggctgaagtcccaggagtaaaatgaacaccaagaaatgtttgttgaatatgtcagtgactgttccctgccaccatgatgtttgttcagatagtgggagagccgtgtaatacatcaacataaagaatggatgccagagctggggaggaggctcagtttgtaaagtgcttgacttgtggtcaggaggacctaagtcaaaatccctcgttcctgaaacactgggcatgggagtgtgtacttgtaaccctagtgctagggttagtgacaggcagatcccaggggctggctggccagcatgtctaggtgcgattgtgagccccaggtccactgagaggccttgtctccaagaataagatggggaagagattggggaaaacatcttgacttctaagtccacactagcaagtgcttctgtgcaacagatacacagacacacacatgcacacacacagacatacatacctaaacatacaaacccagacaagcacatacataaacatatgcacacagacagggatgcacgcatacacacataggtatacatatacacactcatatatacatgcacacagacaaacatacatatatatacacagagagacagaaacatacatactcatacagacatacatatagacagatacaaatagacatacagacatacacagtcacacagagacacatgtgtacacacagacacatgtatacacacacagacatacacatatacaggcacacacatagacatatcgagacacacacacattcacacaaacacacatgcatacacacacagatacatacagacacatactacaaacatacacacatgtacacagacatatacaagcacgtagacacacacaagatgtatacacactcgtacatgtagacatacatgcacatgcatacacacacatacatacacatacatgtagacagacatatacacagagagataatacacacatatacacaaaacaacaacaataatagtaataataatagtaaatgccaagtttacctcaaaatctgaatgtgtttgggtgatagtgggcttgtgatctgcagatctttattctaacttctattagttactgaaataatgctttctatatcacagagcaagaatcaaaattttcagggacctcacacagtctctctgtgttctctgccccaccctccttcccaagctccctctggcttgtgcttgcttgggcacgaacctggctccctggggaagtacccatggggcccttatcctaagctttgttctatcgcttcctactgtgccttcccttgtgtctgggggtgcagcttccccagcctatgatctctatgcaaattctacttctctgtgatggtgcagccctactggccttccagtttaatatgacaggtgtctcatcctgtaccaccactcccacacaaggcctacaaagggaatcattaattaaaaacagttgaatcttggagtgtccaggttgtcttctgctgaggtgcttagacattcgtcacataggtcaagctgtgtgtttcagaggtgaatggttccttttgctgtagggcactttgggggaacttgcatcttcttctggtgtgaaagaggcatgttatgagcctgaatgtcttataaagttcagttacttaactgttcccatgagagggtgttgtaaaggaccagggaagggatgcatcctaggacaataagctcacagaagagtttcagtggcggaggtcttctgagtcacctgagcattgcagctgatcgcgctctctgtcttcctccttcagtaaacctccttgctttctgttccttgtgctgattgattattttaattctaaagctgtcttattgaagtatgtaaagcatttggggatagaatcatggggaaggcattagagaaactaaagatgtattattctgcatggcgctggatagaggctgagtgcactgataaatggcattgtggagggaaacagatccatcctgggcactgtgtgtttgtgccttcccaaggatgtggggaagcacaaatgacgggacatcaggtatgatgctgtgctttgaaataaatcacatggagtcacagagagacctgtttggtatctctgctttctcttctgtgatggcattcacaatttctctcctaaaacttctccctgagctcatgggggcaggagaagggagggcagactcacttccaccactcagatggtgctctgtgatagccagaggatcaatgtgaaaagaatgcaccatgagtgcttggaaacataggtctgtcttgcttctcagaagaatagaatatgtaaaaacaacaacaacaacaacagcaaaaccctcaagaaaactcaaaaaacaaaacaaacaacaacaacaacaaaatctcaaacctaatttatgtgggcctaagccctcgactgtgggaaagactagcgctattgatagaggtaacccagatggttaggcaggtagatgctttctgttgtaggtttctacattgtaggttgctacttctgataagtgcacatcatttttttaagcaacaggattgggtggaatgccccattggacctctttccatggtacctgatctctttgttcatgaagcacactggaatttggaagagaggatttcatgagcctagacataatagcccgtgtcattttcttggcatactccagacccagagcccacccaggctatggtctgtcccttccaaagcccagcagaggaaagaaagggccttggcagggacaagggaaggacttgtccccagacctgtgttgaaaggagattatcagcatgaggcgagcccctgtggataaaagaaaatgatgcagtataagccatcgctcagaagccagctctggccttttagatacttcagaaaaataaatgtggttcatttttctcaaataaattttcatacattattatagctgtctctctggtgctcaacctgaagtggcaaggtagtatttatgggaaaaagcaaactgttttgaaacctgattattcagaattttacagttattgtctaggtttaagagaaaacttcagttgctatatcaataccatgaacacctgggtgtttacagttctcatttttaccactgaagagctccaagaatcaggctggatgctgggagaggacttgatgacagagactcagggatttccttgtgtctaagagtctcagctggctgtgtccagcctggctgtggggccctccttctcctctctgctgctgttaccctgccccaagcattttcctcaaaggcctttcaggagctcatgagaagacccataccacatgcatacacacacacacacacacacacacacacacacacacacacacacacacactttttcctacttaactttcttatataaaacttcatatttctcatgagctaattaacgtctgtggcaatatctgagagtttccactgactactgagccctagtatttgcccacagtgtggtctagtttgtcaagtcggggtgggatggggtctagggggtgtgtaatgacttgggagcagctcctagacaagactggcagggaccagttgacataaagccacttctttgttccatatctggaataacactggtaaaaggtccttccaccacttagattttctaagtagactgacggacaagtgataccagttgtcaatcccagggatgtttccaagggaaccctgtgtaagatcctgagagtatctatcatccatccactcatctatccacccatctatccaaccatccatccatctgtccacccatccatccattcatccatctattcatcatccatatatctacctatccatccatctgtccattcatccagtcatcctttacccatctatccagcatctattattggtaggacacacggtactatcctagatacttaagaaaccaaaacagaactaggacagccaattccattaaggagatctcagcccaataagaacagctagaaacaacatacacaattaggacagagtatacagaaacatttgctattgccttacctaagcctttggtgtgcttagaagttaaaagtgtcttcccataactcacttttgtcgaaaatgatcttcttcctttattcgcttactagcctgatgcccaaatccctttcctgaatagctcattccatctttacatgctccatttctagggagaggcctgagctcctggcagcctcaaacagagtatctggggagtgcacctcggggtggcgatggtgtatgccatggaggttgccagcttcctcccctgtccactggtgaagtccatccttcacctcagaagcagtgtctcctgagcactgtggagcacatctacataaccactgcacccgaggcttcaggcctccttccagaccctgcttctttaaacctagttcttttgctcaactgtgtccttttggtggtttctagttcctttgtgtccttttggtggtttctagttcctttgttttctgtgtccactgaagactaaccctcctggccagagattgttcttcctccctgcagggtgaccagggctgatcccttcaaatagtaccaatccctcgattggcagcagtgccactaagggggggggccatgttacctggggacacagacatctgttaacagtctcagagaagtgcctgtccacagcagcctttcctctgtagaggcatggtggacttctgtagtggtagaagctacagggctggagttaggtgtggcttagtaatagaggacttgattagctagtgcaaagccctgggttctatccccagctcagcaaaatactactacttattagtaaagttgagctctggctctgtgctaaaccttgacctatcgtgtccaaagccttgatatccagctctgtaaattgtatgttcttgtcattattattatttttttttgtgctggtagacatcctggagtcagtcccaagctgccaagtttcagaaggaagcacacagcgtttgctgtgctctatcactcccctattgaagcctgaggaggccactcctgactttatttcttagaagtcactctggctgttgaggtgacacctgctggtcctcaggtagaatttatctcagaccctctgggcttaaccagtcttctagacctcattcctcacatcctctccttgacagtggtagcccaaccctcaagccgtttgagtaagttgtgtatctcctattgcacactccttgagatgatgagcgtttggttttggcttttatagtagagacagagagcataagactagatgccatgcctctttctgcctctctgtggtaccgactgccaaccgcagtcccagatacctgttgtggatttactactttgcatgttctctgtttccgttcaacataggccatgaagaggcctgatttatggagctatgtggttgagggtgggagcagggaagcaaagggctgttccagctgcagtaaatttaagcatcactggtatttctttacacatctggaggggttcctggcgagtgagtgtattgccacaggagctcataaattaaaaataacaagactatttcctttacacctggagcttcaaaattaccacccgttatattctgtgatggccctttcacaaaagaggcattgagggcgacagcctaaacatggtctctggccatagctctaaatacaagtaactattcactccaggtcttttgacctttgctttaaaaaaaaattactggaagataaggaaagtcattacatgaagcatagactgggaatttaatctgctttttttgtccatctctctccctccttcctcttttatgatgtttcatccttctccatttttgctcaggagttttacacaaaatttaaaacaggtctaagagcagcagagacaaagccatccatccagggacttccttcttcattctctgttataagccataagttccactctgtttgcagatgatacgagcccggtgggctggtggtggcactttgattggcacctgtgtaccagagctgatcttagagaactcctgtttcctccccttcctaggggattctctgtctcctgggtcagctgtgctctgctctgccctagagcacaaaactgagatggtccgcaggacacagaaacaactttatttttactttttcatcttgtccttttagaactatgttgacatttttgggaaaatgcacaaagggtgggaggctatgcttttaggcaaggcttttaagtatgttatagcagaagcaatcagactggattttaccaccatgccaccaacagcattgactggagagacacagtggtgtacgctaagatatgcatggatgttgatagagaataagtcataaaaatcaaaacctggaagccttgcaaatgttctctgacagataagtaaataagcaaaacatgagatgttttatacagcaggatacccttcaaatgttcagactgttgctacttgtgataatttacgtggatctcagaataatcatgtgactgaaaataaaccaggctccctgctaaaaccagaacactcctcatcatgtgatttcatctgttatagaattataaacaacataaactaatttagtgacacaaagtgcttttgggtatggtagtcacttctctaacctcagtgctgaggagccgagagaccccggccaggccatctagccaaaacagtgagctccaagttcaatgagagatcctgctcaagaaacaaagtgaagagccagagagggggtaatgctggcatcaacctctggcctttacatgtgtagacatgcacacacacacacacacacacacacacacacacacacacacacactgaaaagtatttgagaaggtgagaaaattgtcttagagtgaacaaagtttgggacaaacggtcatttccttaggaaggaaagcataaataccaagaatcccacggaaggcacggaattggctcaaccacacagccccaaacaattaagggggaaagctccaaacttggagttatatttttccaggaaataaaaaaatcatcactcgggagacagatttctgagttcaaggctggcctggtctacagagtgagttccaggacagccagggctatacagagaaaccctgtctcaaaaaaaccaaataaataaataaataaataaataaataaataaataaaatcagggctgaatagtctgggagaaatgagtagaagagattacataagagaggagaaacagctaaggcaaaatgtgtgtgtgtgtgtgtgtgtgtgtgtgtgtgtgcacattcacatgcgcatgcgtacacatttttgtctagacagaggccatgcatgctcttgtgggatagccctgtgtttgtggatacatgtaaagtcagtggatgacctcagctattttttcacatgagccttctgccttttgtttgagacaaggatgctcatcagctggaactctgccaagctgtctagctggctggccagcacactattacaagcgtgtactacctgtctacctttatacctgggttctgggggatccttaggcaagtaattgactgactgagcatttccccatctctaatcattcttttgaggtgattgcccctgagatatttcccaactgaggagatgaactaaagacggagtcactagaatttcatttgatagttatgatctgcaagctttgttggacattatcatggagagtattggaaacagagtaaagcagaaaagtatcatcttacctttgcacaaaataaaatttaaacctgggagattgtggtggtttgaatgggaatggccctatagggtcatgtgtttgaatgcttggttgatggaactgtttgagaaggattaaggggtgtgaccttattggagaagatgtgccactggggcagggtttgaggtctcataagctcatgttattcccaattctctctctgcttgtggttgtggataagattacagctctcagctactgctcccgttccagtgctatgcctgcttgcctgcctgctgccatgctccccatcatgacggccatgggctcaccctctgaaactgtaagccccaaagaaactcttcattaataagttgccttggtcatggtgctttgtcacagcaatggaaaagcaactaaggcaaagatcttaagtattatcaacaccttgaaacataaataataatgggctgtgaatgcagcttaatagttaacccaaggccctgggttcaatcaccaagacagaaaaataaattaattaacaaaggaagtaaaataccatcgaggagtgtgaattgaaataataaagacttgtgctaaagatcctacaagagataatgactgattagaacttcctggttgtagaaagttaggatgttacaaatggacagccatgttatcttacgttatcgttagccttcttaatggacgtttattctctatgtctgtatccgacatcctgttggagttaaaatgcaaaagaaggaaagagacaacattaataaaaataaacccctagaatacatccaccttgtgaaccactagcttccacttccaccaacccagcagctgagaacagcatctgagatctatgccagagaagtccctgctctactgttaactgctggcctgagaaccccaacaaagtatttggaaaacaccctgtgatttatgactctccattctgtaacttaaaaaatgtcatgaaaccatctccatgttggaccatgttatttgggctatggtccattctaaatggtccagtaaacgactctctcattccccttgaggtgagagctacagcaggtacaggagtcggagaacaggcagttaaactaatgcctcagtctggatgacaggatctagggggagctgagcagctcatttgacagttggatagattattcagtaaatcttgggtttatctcttaagcccagaagaagctgcactggggaaaaacaaaaagcaagcagttttccacaccttaagacacagcagcaactgtgaatataaatatgtaggtccaggtgaatttacagacagcaggctgataggctgcttctagacaaaggaggcatttgggaacaagtccccagtcaagtccatgaatggtcatagtatgacgtgacatcttaggaagagagtgacttctcagcccagtgcactaggaatccagtccagtatgatggcagtccttgtttggtcctgacatcttttaaagcatttacaaaatggctaccttatcctggacatttttctcaagcaacaaatcccttgaggtaaatgcttgaagctggctgaaagcagacaaggattgagaaactccttgggcttgccatactcatcctgactcctcccaggagacagggcagtgggtaggatggtagagagtaaactctgacatcccaggactctgcggtgaacgtcagtgtggcatatgtctggcagttccctcagcacctggattgtttcatgcccataggaggtgagactagacagtgacaataaaaatcaatgtagccatcccccaaagacagataacagcctgacattgcttgatggcttcctgtacaatcccaaagtgctactctgggactgcaaactccagccatcttcatggtgagagcccagagaacaaagatagtaactcccactgcattcgagaggaccaagggacagggagacgattctggcctgtgtgtatcaccagaaagtagtgccagcttcatgttgggaagtgaagagacaggatgcctggggccctctcagcacaggagtagaaggtctgtgttggaaaagagtctagttgagagaaaagaaagcactcttttcccagatgtcggcacctcagccacaactaaacaagcctctttgtctgtggctggcatcttgtttgatgtgatcctgtagttttctgatgctctgtgaccaccagggcatccttctcctttcttgccccgccctgagtcatctaccagcttcccccacacagaggttccaatcctctcagctaacaagtgtgtgactccaaccttaacgagcaaacagacagactccagagaggaacaggagtaggacattcctatacttctatgttgagatggataaccaaagctaaccacaccagcagaaggtgagcaacacattaaacagaggggaaaggataataaaatatcgcctgctgtttaacaatcgccgggtggaaacattccgggaactgtgcagctgccgcacttgatggctcataaagcccctgtaacgtccgtcaagggccttttttcttggtgaggggccatttttttccatgcagttatgatagcatctggttcctgtccctagaagtacagggaatccacaggctcgggcagtggctgccaggggaagaactgggctgcagaggcatctggctccttggatgactttgggggtcacttctgacctaaagggcattatcacaaaaatgcagattaggattcagtgggaagtcactgtcacctgttgtgtgctaggaaggcactgggtagtttagctcgtgtatcccctctactgtgaggtcgccattctcatcactgcaaaatcagtgtcccaggctgggtaaaggacacagttaggccacactgttaacaagtgacaggctgagttccaagtggcgaataagtgtaaactgctcgaactatgtcacatcttgctgtgtcatctttctgcgaagatggagggtacatggcatatggaaaaaaaaaaagtctctgcatttgcttagcctacctgggtacctgggtagatgtgttgaaaagagtatttttcctgaataatagacatcagtggtggcagccctaagcatgcgctggtttccattgggttccccagacctacacccagaagtaaggatgcctatggaataagaatgtggtccctagggtgtgtgagaacattaaatgggaaataaaaatagaagaagaaaaaagaagccagagactgagacagttctagataaatctggtagtgggtggcatctgctccagcctgactctacttgggaaccctcaggggtatacagagttgtcctgacctggggacagacatgaagggggggggctcgctgtcccctcctggctgttaagctctgtggctgctgtagtaaggaggacgtgatcataaatccagctctcaggcagagcagcctccagcagcccagggcaggctttgcagaagaggtataggaagcaaaagcatgtttgagaggggaatgcaggggtctgggctgggcgaggccaccgttacccaccactgcctgcccctggcacccgtctggcaggaagcaagccagcaatacccaggactgaaaagcaacctgtgacgtagttcaagcagtttacacttagccctgtgtagcttaccagtgaatgagagttagactgtggttattttatttggttttgacaattgctgggggtaaccccaatctattattgtaactgctgatctggctaagtcctaagatgtataccccaaatacttgctggtttttctggctgtgtgttcctggtctgtctcctctcatgggagcttcctcttccctccttgtcctgccttctcttcttcctctgtaacctccaaccaggtaactcaaaactccctctaatccctccgtaattgggctgtgccatttctatttaaacaatggttttaaataaaggaacaaagtttgcacaacaagagctggtaaaggtaaaaatttactcttaggcaactagatcttccggtacataatttagcattacaatacacaacaacagaccagagctcaacactggggtttctacccaactcacgtgtatccacagaaagagtgctggtcttcctggattcgaatccaggaagtcagccaagtgcaggtatctcagtttcaagccaggtcactgtgcagtagttcatcaggttacttcaggttactttatgtcataaggtctaacagtataatgccgacttccacttcttgagaatcaaaggaagttatctctaggcaaagttccaggtttttgttacaaagtggaaaaccaaaaaagggaaaatgaaaagtgagggatcgcccaggatagggctctcctatctgaacccttgctgtgtggtgaagcaacgcagcttccagaattcacacacacctctctccaaagccaatagcagcatgcagcagaatcctagagcatgtgaatccacagaaaccatctctcctgtttaaacagtgtcgactttattatggggcatgggtcctagcaggatacaagcaccacactcctatgtaatttgcagcagaacatggcctgtccttggtttattgcatattatcttgtccctcaacatgcagggccctagaaccaagcatgtgatatggttttaatgctgtggcttagcagaggcaaggacagatatttgtttccttgagctggtggatggagtgtggggtgtcttccagcatcctcagcctggacactacaatagaggaagccttcataataaattaaaaaggtataaaatattaagatgtttcttaataacaatggagtttcgtcttcttaagtgttcctgtcctgtagagtttggtactaaagtcctggcagatttaaagctatgatagtgagaattgcttcacagtaatggcaacagaagtgggaggaacagagaagaacagatgcagagctgccacgggccagtgactctgacactgaggcgcacctagagagactcttcatttttcaatgcgtatttggaattttccatagtagcaagtaaaatagatcataagcctagtttgctctcagagattccttcagaagactgtctggaggtcttgcccactggtccctgactgtccttcatgttttgtctggttcctaaaatatttctgccacagagctcagatcttagggccactataaaaatactggagggtgatctataaaggacacacttatttcatatagatctggattctaggaattctaggtccagtggtccacatctggtgaagaccttatacatttccggatcatagcatgtcaacagcatcaactgagctaggacaggcagcaggcagcaggcagcaagcaggcagcaggtggcaggtagcaggcagcaggcagcgggcaggagcataagatgctcctgttatcaggaaaccatgcttggaacagttaactcacaactcagtcttgcaataacagtgctagtctatttactagggcagagctctgatgccctgattcccccttaatggtcctgattctccaatatgatagagggacttggggagcacatgcaaatcctaacagatgactcccagcctgtggcccccacctctgctgttactctactatcatcccagaaccccactcttccagtcttaaagctccccaatttacaaccgaagagcgttgtaatcccattaggcttcctcccatacttcttgcaaaattacttgtgatatgagagacagggttcctttgagcaggacagcatttatttctattgccccgacctcatcacgccgccttgcacagacagagctctttaggtagacactgggtctgcttgtttctcagaaggttttatagtgctactcaagagaagtaaatggaagggagcaaaaggtaggaagtggagatttagtctcaagtgcaaccttggatgtagactagccatgtggggcaccagaccaggaatgggctcagaaaggcactatgcctgtagctgcagagtcctagttcccaagggggcatttatccaggaggctcacctccttttggtaattatggaggctctggaggttaaataggaaaaccctaaattgcaactgctatacttgagagtaagctttaaaaaaatactaaaaacaagcaaacactgcccccccccaaaaaaaacctatcatctagaaactcatatgaatagtagtatgtctcatggggaattctccctgaagaagtgtctgatagaactaaaggctcttccctctcccagtttgcaaaggattaactccagcccctctcatttcttacaggccaattgctactggtgtccctgtggtgtgcccacagatggtgcagtgggtcctggaagggaaaagaaagttatgttattcagggaagaaaatggaatcttccctcacatttggagactatgtttcttacctttagcccgtggtctctatgataagggccatcttccacaaactctatgaactcctgggatatagttaggttgactatcaatactatcgattgattgacagtggtagattggtactctactttgcagatgttagccctgcttcagtattagctttgtctgtttgcttatcactgtgaggagggcaggtcttgatggtgtccttgctgacccagcgctgcactgtgacagctcctgtgttctatgtttgctgcagaaaatcactgagtggttagcgctgaggagcacatgggtggtattatagttttaacttttcagattaagtcagcactgcagggcttttgttttgttttgttttgttttgttttgttttgttttgtttgtttgtttaaagcatccacagagcgagtaagaattgagcaccaggaggagaaatcagagttcttatacttacacctgtccccaaactcctgtgttggaggcttaattcccaatgcttgtagtacccaaacgtgaggcttgtaggaagtaattagactaggaggactctactcacagaggcatgactgatgtccttctaaaagagccctgagggagtccgtccttctagcctatcatgtgaggatatgtagaaggcaccatccatccatgggcttgagcctgctggtgtctcgattgcttgtcttcctagtctatggaactgtgagcaaagatttctgttctttataaacaacttcatttaaagcattttgctatagcatcaagagcagactaagacagagactgatcatgttaggaaggcattaagataggtcttgaggtgtggctgatgctcaaaggactggaggggatgttggagtttcttccttagtgtaaatgtcataaaaacatctcatgactcttagtttggtctggaatttaatagctatactttagttataggcttagagtcacaacctagggttaaggtagagttttatattatatagagctacattgaattttaatactattgtgatatatatatatatatatatatatatatatatatatatatatatatatatatgaatgatatatatcatacctgtagagcccagatgtgtggtttgacctttaactagacttggaaaattgtgatattttgttttcttgtaggccaggctgactattcacagtatagccaagactattttaaaaccccattccctaactttaactcctggtctccctgcctacagatcccaaatattggggttatgggcatgtaccaacacatctggctagcctcgtgatgcttaaagtcttcgcatccagtagccattacaagcttgggcagtagaaaatgtaaccagggcattcctggagaagagaatatgccaggaccccaaaacaaaaatctactgagcacatctgaaccacggggctgattctgttgcattggcccataaggccagagcagcagcatgtggtctgaaggagcatagaagcagacactctgccatgctaccagaaaggggccagcatctgcagctgccatcagccatgagggaccgcactcgggatgagttctaaatccctgcagactgatgtcacacagaagcgatttacacaggctgaggacagcagggtggaaaaaaggggaaaacgcaaaaaaaaaaaaaaaacaaccaaccaaccaacaaacaaacaaacaccccagacgtttttaaaaaccaaggagagctatctacaaggccagaggctagctgggcataccccaacaggaaacacatttccccaataatcttgttgcatggggtctttggatggcttacctttgaatcgcttctgtttatggagtctcagcaatgcctttcactgtcaggaaacctttctcttttcagacctagtcctcatggctagctagctctggagctctaaggccccagattaatcgcctcctctctggctgacttacacttccatcttgtgctgtccagcagaagaattactggggacaaggtcacggatgcactcagcattggctagtccagagccctttacactggacgtaaagggaggcagaaattataactttcccatctcaggctggattatggaattttgtagtgaagatactgctaaaacctttggttgatgaggagataaaatagccttgatatgtgtctgctagagggaaacatacatttccagtgacagtttgcatggaggatgttcacctcctataacatgcatctatcgttcacgcgttatcttatgcactcactgttggtgcttgcagctaatgggttcatcgcaaagtggggttaccgtacatggaatccgtttttattctcaaatgtagaaaagatgtctggctaccatggttgtgttgttgctgatgagagggagaaatataccaggatggtccaatgggtatgtgttttgccttgcgcaacaccaacagtacagtacaaaatacagctggcatgtgtctggatagagtgtggcagacttctctctttctgccggactgctgcgggccgtcagttgctccctgcagttggtattttgggtggtcattttctctcgttgttttcatggttccatctgtaagttgctttccctagctagcttcagaggcagaaggagaggcggaggagaatgagtgttacaaaataacaaaacccaaagcgacatcatgtgggtatgaagtttgaatgaaactttacgataaagcacgggctcctaagcttttttttttttttttttttttttttttgctagatttggacagcttgagtaaattttcctgtcactccttctgtattatcatatgttctggtgaaaaggaatacggttttgcatttacagagtaaatcattttgacctgtttaaaaccgttttcccagtttttctgtttactacctgactgagcttagctttagctctgttgtttctttactcgtctttcttttggattgtaccgttcttttctgtagcatttggaacctgagatctaatgcatcctttaaattgctattaatatttaggctgcaattttttttattactgaccatgttagttgcagtttatagattctgatatgtagtgtttccttaacattttggtggtattctctttttttactcaatatcatccgtatcttaaaaaaaaaaaaaaaaaagaatacatttccaagggaagagggtccctgtctccctgtgctagggcctccctcatccatgttagggaacattttctttcattgagttatagcctagaagagcctttttgttattttgcttttaaacctttctagtttaattgcattgtgatcagataatattgtatcaattcatttattcattatttatgtgtatatacacaatgtatgtatttctgtgtgtgcataattgtgtgtgtgtggggggggatatgtgtgtgcacacatgtgcatatgtaggcaccgtggtgcctgtgtggagatcagagagcagcctcagccatcagtcctcatgacatcctatgtttgagatagggtctcttggtggttctttctctgggtttgctaggtactctgtcccgtgagcttccaggagtttcttgactctgccccctacctctctctaggaacactgggatcacagatgcacctccatgtccacctttttttgtgggttctgaggcagatggaagccttcacacatgcagtgagcactttaaatcctaatgcagtctccttggcccatgctgctgctgctgctgcttctccctctccctctccctctccctctccctctccctctccctctccctctccctctccctctccctctccctctccctctccctctccctctccctctccctctccctcttcctctcctcctcctccctcttctcctccccctcttcctcctcctccttcttcttcttatttcacatagcatgtagaggttttctctgtgatttaatgagtggtaagatagtatgaattgcagtagagaatatgcatgctctgccatctagttgcaaagtatagtgtagatttagacctctttattttaaaaggacatatttatcatgatcagctacataaaataaactttatgacattgggagttttaagtgtacaactcagtgtcattagttatattcacagtgctctacagctgccattgctatctgcttccaaaactttcatcactgcaagtggctactttgtaaccaatgagcaacaagtaaatctccatctgcctattgacctctggtttatcttctgtctctaggatttgcctattctggacttgtcatgtaagcagagtcaaacagcatgtgtccctttcatggctggcttagctggctatgttgacacaatgttcttaaggtttgccaatacagtggcatgtgttagaattcaatccctctttatgcctgaagaatgcttctgtgtgtgcacatgccgcactctggttatccactcttctgctcctggacctttgggttaatttcttttctggcgccattgctgaagaaagtgtgacggacatgagcaggtaaagcatctctttgggtctctgtgtcaactttttttgcctctgcacctctgggtggaattgttgagctccgtggcaggcaattgcacatgcagccttctgaggaactgcactctgcacccatgctttccatggcaaccacacaattttgcgtttctcccaggatgacgcgagggctcctggttgtttgttttgttttgtttttttccagcctcactatttgtttttcttttaaaatgacaacaattctagtgggtgtgagattgtataatgtgttttttaaatttgcatttccctaatagttaatgatgttgatcaactcttcatgtacatatagaatgcttgattatcttctttgggaaaaaatgtcagttcaaatccctgttctgttttctaagctttcttttgctgttgagtttagaatctctgtagaaactctggatattaagcctgatttgcagatactttgggcgttctttaggttgtcttttatttctcttctaataatcctttgggggcacccaagcctttacttttgatgaagttcaatgatctatttttttttgtaaacttatttatttatacatatgagtgcactgtcactgtcttcagacacaccagaagagggcatcagatcccattacagatggttgtgagccaccatgtggttgctgggaattggactcaggacctctggaagagcagtcagtactcctaacagatgagccatctctccagccctgatctgctttcttagctgttgttgctcatacctggaacattcaacctaagagtccatgccaagtcctatattcgattcgatctatatttttcctaagagttttatagactcagcttttatatttagttatttatcgttctgagtgaattttttggatggtgtgaagagtcagctgcattcttttgcatatacaaatccagcacaccagaaaaatctgtgattgatcttgatgtactcgggcctcttagagccatgctaaactgtttgggagcctgagataaaaggaaaaatcagtggtggtttttgtgtcttcagatgggatttcaagatagacatcacatggaacgatgtgtttactgagggttttgttttgttttgttttgttttttgtttactgagttttttacacctctttcagttgtacatgtaagacacagacctggcccttccatcccagccccagccataggaaaaggctctggctagtgtttctctcccccagctctatcgtttttctttttctttcactctaactttttttgaagcagctactatacaaatatatatatatatatgtatatatatatatagatagatagatatgcgccatttaaaatataggtgttataattttgctatgaaatgtgactttcagggttgcactatcttttatcttgtttaacgtttgggggctggattttactttgctataaggatcatagaccagaggtgaaaacccgaggtcctgtccactctctagtttgtatttgatgagtatgaagctcatcaactttagcaacagtcaaaattactgtggtcacaaagttaaaaacaaattactccacttcttagttctgactcagtcacagcctccttgaatggtaacattttcaaactgggcaaatatcctcaacatgttcaagtagggataggctacaaacccagccaagagcttacatgttcaggtccaggtaagctttgggaaaaagatggtacctcctaggatttaaagtgacccttggctgaatacatctcatacagatttggaagatgtaagttggaggaaggccagttggctgaggaggaggattcaacttattttccataatttgagatgtttttagtaagattctgagttccttttaactgccataagttctatgagtgaaggccgtattttattgctctataaaatatagagtctctttacagtttgttcttgggattcttgctataactctataccctagtttcctaagttcagcactcactgaggatgcctgaaaccttggacggagtacattatttcctatacacacatcataatttaatttataaattaagcatggcaagtgcctactaataattgataattacatgtagatatatagttattacagtatactataataaaagttgcacagatgtggtctttttctccaagtatcttgctcaacagcactcacccttctcggggtgatgtgataataacccaatgcccatacgatgataagaggaagtcaatgctgcaggccttctgggtatcatctggagaaagggcagaaggacagttcatagcccaggaaggatgatgggaaatgacatgatattttatcatgctgctcagaacatgatgcaatttaaaactttcacgtggagtacttctgaaatttttggtttactatttaagagctgcggtcgatcataggtattgaaactggattaaagggactattatgttaatcagcctgggtgcattcaagcagttgggctgtacttgaggctacagtcttagttttcctctcaacagttctcgcatctgtgtttgagcatctagggaagtgaagctgaagaagtggaaatcaaacccggctggggtttggcctcacctgcccctccccagtgcattcctgcttctcactgcacgttgacttccgtgaacagggaagagaagggcacaagctggcccagaaagtctccttcctttgtttccctctgaggtgctcaaaagcatcaataacagtgtgggaaagccctggctgaacagaacttcgcaggtcccccttgataccttccactgggagcctccacacaatgccttagaaagcgctctgtcagccaactgctgcttcaggcaagcgtggaggtagcctctgaggagtcctcggtgggaaagacctgccctgccccagaaactgccctagttctcagccagcaggctcctctgcaggagagaagcacccctcaggttttgatttccttttccctctcccttctgtccttaggaccagggaaactctcagcggggcttggctttctaacaagcatcaatgcctaggtagctcacgttcccttggtagagacaaagtctctgcgttaggagttgcttagctgtgccttccatttgaggttaagaaaaaaagagatgctggatatttagatctgtctacttgtttctgttatcttgagctgaggctggcctccgactcattatgtaacccaggctggccttagatttttgttttttgttttttaatacttatgcttccacttcccaagagctggcgttacacgtgcagttcttgtcaatcagcctgctgccatggagccttttgtcacccggctgccctaggctggctccagatcatatttacactaatatcctacctctcaatagtgcctgttggttgattttaattgagtagaattagtcctgagccattggttgattttaattgaatagaattagtcctgagccatcgagataagaagaccataggacatcagcatttacagttgcagcacgagcaaatgcttgaagtgtggtacccagaggagacttttctctatacgggagagaagcctggctggatacagagggcggtggagaggacagatattgtttacaaaacagtgttcagcatatgagttaaatagaccccaggagtgaagcagagagtgtatattgtccagaatactgtagttaggcagacctatcccaacaggacccaacagcctgcaagccttggtatgtttctctgggcttcctttagcttacaatggcccacttggggtgacagccacccagtgctggtgtgatcttcacttcccatctctgtaagggacttgagcacctgtggagtgggagtatccagggagttctgggaacccgtggtgggtgtgtgggcgggtgacagcatacatcgtttacagcatccagtttacccgagcagaatattctcagctgatgttttttgtttttttcttgaatgtttgcccatgtcattttatatgaacggaaaaacaaacccaaacgagcctctggttatcccattacatcataacatcttatttaatgactaccctgttgtatatttaagtgactcgctatgataaagctctttctctgagtatccttgcatgagaagtcccatgcatgtccctgtttgctgtcttcacctgtaagtctagcaggaaaatctttggggctgctgctattgttaagctgtttggggcagagggccacactctgcccgggtgctgagtactcagtcccctggatttgtaccaagactgagtgttacctttgccctttgatagcttaaaattgtataacgtttgaaaattcccccacgtttcctttggttagtggtttctgctaaagttttttgtttcttttctttcatactcttcttggagtatttggggggttttcctagtttctaaagaactccattatgttatttttaaagtatgaactgagttacccaaaatattttaatttttaatgaaactgcagtggccaagctccttttataatataaccccattatcgtttcccaaccctggcatggggctgtgcacactcaggggactacataaatgcttttaaatgagagaacgatccattatctaaatatgccattgatgtacagggttggttcgtaaagtaacacgagaatttttttcttgaccattaggaattataataaggaaaacttttataatgaattgctctagggagggaagctgcaaggtaaacagcgtgtcatatctgtggcctcagactgcagctcatcacagaggacagatgttctcaaccaaagcaaaagtaggcactgactgtgcccgacactcctgcaacctcacaacccagatggctgaggcagggagatcatgattctgaggttggggccgcagactgagattccacatcaaaacagacaaggaaacaacaacaaaaccaatagtacagctcagatgctttttcaagtcaagcagtagtttatacatacaaactgtgactagaagaagaaagcttagaagtcataaggtccccactcatcaatcatttcctaaggaaataagacagcagtatggttgaggcctctgcagaccttgttcatctctctcctcttcccctccagaagtgctcggtttaaacacccggcatacatgtttctctaagcaacgtgaaacattgtgtcacagttttagagttttgacaaatgttaccatccatgtttctgttgcaacattacttcctcagcgttatgcttctgggattgaagcatcttaataaagtggggctgatctattctgtggaaataccacaacttatttatcctccctcttcaccatcatcccaatattttgtgtttgtgcacactgttgggaatgtgtgtccatcacctccccttgtgcgcatgtgcaagctttcaaaggtagtgatgaggttgctccaacatagagatgtctgccttctccttttctagaagctgccaaattgctttttgtggtttaaggtaatacagaaatacttgcattttccccgaggaagtcttgcaaaaattaggccagttattatttttgagtgctggagggccagaactgctccaaggatgaacacgcattccagtctgcatcttttctgctttgggaaacagataaaaatactgaggatcttgcccaggcttaatagcaaggggcagaaacctagtcaactgtcctcaaacccatctcttagcagcagtccaagctccaggtggtagcaagagaccagctatactatatttaaaatgacatgaagatagcagccaaagactctaagggggcaggggggtggggtggggaaaggcaggatgagccttgggcaggtactgctgttccagggtgtggaagaacaagcagatggtgactgaatttattcagcatccactaatgagtctgaccaaaagtccgttccaggctccatatgctccgaattcagttccatcctttcctgcctgcttcactgtagaggttcgttgctcatatcttcatgcactttaaagttccttttaacctaggacaggcgacttgccacagaaaggtcaaataaattttttagaagcaataacggatgcaacttgtacatgtgaattttaattgcaacactctaatccccattccaagtgccaaactttcaggattaatttgttgcatgtgttggtaacagggcactcagtcttcggagcggattcattgcccgagggccctcatttgctaatgagtaattgttgcaattttcagagaaaatgctactggtacaatcatgtttgagcattcatcaaatatgacgtgagcccagttaggagaaacgttagcgtccttagcctgcaaataaaagccaagcattcatttccagcatggtaatttccctaggctggtcacctccattatcattcggaacaaccggtgaactgtaggtagtacctgcgggtaggagcaggttttagcactgttaagtctgtagtcttgttccattgtatcttgtcactcaggcccattttggaagtaggcaggggtggaagaggaagccacttcggtaggaatgcatctctgtgtgcacacatcacagacagcaatgacatgctaattacagctttagacggagcatttcctctttctgcattttgtttgcaaacacccaattatttccatcctgcggtctggagaagaggaaaaaaaaaaggaaagcaaatccaagggagttgatcagtagtttctgcaaggctcgctgcctacctatctcctctgttgtggcttttcttcccgacaggttggaatttgaactctgcttgcttcccaatttagttattcttttagatccatttattattactattgttatgatgatgatgatgatgataatgagtgtgtgtgtgtgtgtgtgtgtgtgtgtgtgtgtgtgtgtgtttacctgcatgtatataagcataccctgtgcatgcagtgcccacagaggccagatgagggcaccaaatcttctggaactttctttacagttatgaactgccctgtgggtgctgggacccaatcctgtgctctctgcaagagcatctagtgcttttaactcctgagtcgtgtctctgccccctagttatctttttactcctacttgtctgtggaccagtggttgagattctacatctatatcaaggagttcagccttgtctattgtaggacatagaaatagcaccttgtgcctgtccagactgcacggaactgatgtcccatgcacttgtggcatgttcctgcacaaggcactgctgcttcctctgggaccacataggctatgcaacattgtggaacctggacatatagaatcttgggatggaccagtcaatgaatgggagcattgtggttacctgagctggaagaagagctgagttcgtaagtcaaaacaaaactatgttctagagcagcagaaataaaaaaatatgtttgaagagtggaataaaaatctcatactggcgaggataagcctgttcttttggtgaaaccacatttgcctgtttttgcttttgtttcctgtgattggagggtcttgtaaattagttggactgatagcccagacaaacctgcagtgccagcaacttggaaggactgaggaatgatttctgtgagttcaaggtcaacctggtttacagaatgagtttgaggccagccagggctacagagcaagatctgaaaaataaaacaacaatggctcccccaacaaaagacccaaaaagaaaagacgaaagctaataatagacaaactaataaaacaagatatttaaaatagtgcctacactggagtctttgagagtttcccatgtgtttctttcatgagtttctgagtttgaggggtttttttgttcattttttttttattctattttccctggttctggggttgaacctagagactcatacatgggctcagcccctgagctcggtcacagctcatcagctcttagatttaggttttcgggtgggttgtttttgcacagtgaacttgatttgctcgctgtgctccacacagaaaggcccagcttccccagcactgttttcggaacaggctgtcccctctcccgtgtgtgtcttggcacctctgttaggaatcagttggctgtagatgctgggtacctgtcagcggatgaatagagaaagaaagcgtggctctctatgcacaatgcagtgccatccaaccataaagaataatacaatcctgtcggttttggcaaggcaggtggagctggggaacactgtgttaagtaaaacgggacaaacaaaacgacaggcacccctgcatcccatctcatacccagagcagctagtgttggcctgagcatcaagcagtgggtagagtggtcaaaaggagctttgatttcttcagccatgtggtatttatgaaatgaaataaccacactagactcccatcatgtgtgcacttaacacattttaatcaaaaaggacataagatcaaaaacaaatggcaggatgggagatgggagaatggtggtacagtctggtgatccagtgcaaggctgctcctgtttctatgcaggcacaaaaggacacaccaagctcgggcatgtggagtataaagtccatgactaaggtctcttcctctttccctgatatctccccctcagcccccccgcccccaaccaccatcacttgtagtccatggaagaataaggaaacccagaaaggcactagattatctcaagaacaacctagccccacttttggaaatagaatctgattatagcacatccatttccttgtgcagttgactgtgcctgatctgggaaacagtgctaaagatcatgtgattgattctgttattttaggtatttatttatttgtgtgtgtgtgtgtgtgtgtgtgtgtgtgtgtgtgtgtgtgaactctgtgtttgtttatgtgtccatggatgtgcatttatatacgtgtatgcatgtgatgtttgtgtgtgtatacacgtgtgtggcctgtactgtaattctaaacagtgttggattacttaggagtgacacagcaaacgttctaaatagacttcttggttctaccttctcacaggttttctgaaccttatagccagtcagagcagcttctcattggtcactaagcatacaggggccaagtggtaatctgctgggacaaaccaaggaacaaggaagtgaatacagaatgtttgatcccgttacacaactgctttgcaaggttaagtttaggtctctgtgggagatatcttgagtagactcggattatacacagctatcatcattgcacagcaacctcgatcttcatgaggtcagccatacctgctgacagaagaccactaggatcaggcttagtaactattgatgttcctgcacggaaagaagaggtagagatgttattggactcccacctatcctggccagtcctatttattccttctctgagcacatgtgatctgaccatatgggtctagggaaggactagatatataggctcagggaagttaactgaagggaactccatctgcatggacagtggagaagctgtcatgcaggctggtgaagacctccctgtgtggctgctttgcggtcacccaggcttctctaggcaccgctcacatgctcagtaaataagcttcactggttttctcagggtgagcagcagttagacagctttagtttgtcattaggaccatatgaggcagggcggggcattgttttatgtctccctaggggagaaatcccttgacaaaacagtaaagggttttctaacactctaaacgtcttattcctgagctcatcgtggagaatgggaagggtattgtaattatgatgctatgggatggctgtcaatgtgtagatatcagatggctgtaaaacatacagatatataggatggctgtaaaacatatagaaagaatgccttgcaaaacttagtttgtcgcgtgttcttttctaaaggatgtaaacatttccttttcttgtgtgcgtatgagtgttttgcttacatcaatcaccatacaacacgtgtatgcagtgcctgcaggagccagatgggggcatcagattccctggtacaggagttccagatggttctgagttgccatgtgaatgctgagaactgaactcagctggggcctctgaaagaacaagacgtgctcttaactgccgagctgactctccagtcctgtctacagccttctaacaccaagtttgtagttacttcctaaaataccgagattggcatattttgtacaactgaatatttcaaacagccaatccaaactagagctaggccactaactctgaagggggaggaagtgaccggcttggccatgatctcctttactcacttcttcacaggggaaacacagtattcatggcaaacatcagccctagttgggtagctttggggtgtcagtaccctcgataactaccgaagacaccatcttgttttgcgcttataataaatagccacacgagaaagcagagacacagagttgtcaagccatggcctagaccttttagttttccagagacctggtgctctgcatgttagttgcccaatccactagacttggggctttgaactcaaggtgttttgatgtaagttaccttctacggagatgtcaacgggcaatgaatggattaatgagtgggtgatgcttataagaagtcccaggaagattcagagagactttgccagcccagtgatttatgctcagactggagacaaagtgtagtataagacacgtaagtccagcagaatgggcagatggaagccatgggaaatgaaatgggtcacatgactgctaagatgccttctgtcttctacctatgcctagtaggaccctgtaagaagacagcctaccccttccaatgccctggaaggcagagtagccactgtgtttgtatgccagcctgagaaaataagaccgataccagctgccactgactggggctcaacccattgcacatcctgtgtcaggtcctcacatcggcccttgtagatatcacctctattttgtacaggaggaaactgagtgccacttgaccctacctgcccttggggattgaaggtgaggtggtgcagagtcaatgactcagacttcaggagcaggtgagaaacgctgcagcgagctcatctgaacactgctgcaagctcctttaataccctccacccacaccccattagccccaagaaagcatctcttataaacagcagcttctgattggctggcactgtctgcatcagcaatccttggtctcccagatgttcctcaattaggtcctcctgcaggagatgcttttgtggctgcgtggcccatcgtttacatagtggtggccccactgccgccaccactcctgctacaactgaggaaagtcaggtgacttgcagtgtctcagggctcagaagtagaagtgaggtcagaatttatgcagtggcaaagcagttatcaagcttgaggtccccacagcatcaggtatctccagggatcaacattatggtgggttttcttcagttttccttgcctggaaaggctaagtaggaaccagaatgccctggagcatgatagaagtgaatctagacacatgaagggcctcatagactcctggggaccatgaaggcagtggttaaagaggcttcttgaggcaactctggcacaatctctgtgtgtgcagcatatgttcatgctcttggtgtgtgcagcatatgttcatgctcttggtgtgtgcagcatatgtccatgctcttggtacagctattgctagcctaactccagagccacttcatcttgtacagattgtgagtcaaggtgtgagaggaagtggcaggttgtgagattgatctgtggcctgtcagtgagtttgactcaattccaggaaactagcagtggacgaacgtgagattccattgtgtattaacgccccagagacaaacccatgcctcctattctctagttgggaatattgtgttgccagcttcaaggtctaagattttctttgaatgatttttttttcatgattcattgtgagatacattttattattgctgtgctgcagagattgaaaaaataaagtatattctcctctctctttgtaaaatgtagactttacttatatctaatcatgccatccctacccttcctagcctttccccaatcctccctgttccttcatgtgtcagtcagctttctgttgctgtaacaaaaatccctgatataaaaaaggaggaggaaaggcaaccttcttgctcccatgctgttaactgctgtattctgctatgtcgtcacagcttgctagatggcacttttaagatggtgagccaaaataaaccactcttccccctgatttctttgtgccagagaaagctaacacattggcccttaatctcaatattcttttttacataccttttatctgaatgtctgagttttacttttatctgtcttagttggtatcttattgctgtgaagagacaccatgaccaagacaactcattataaaagaaagcagttaagtggaagcttgctttcaagtttagaagttagtccattatcatcatgatgggaacatggcagcaaacagggagacatggtgctggagaactagctgagagttctacatcctgatatataggcagagagaggaggagcaggagactggagctggggtgggtttgctaaccctcaaagcctaccccagttacactcttctttcagcaaggccacacctactccaatacagcatcaattcctaatccttctcaaacaagccactgtctaatgactaagcattcaaatatatggtcatatggggttcattgcttttcaaaccatcacagtctacacagacaagaactcgatggaagagggatcttgttgactctctggttttctgctctacacctatacttagacctcgacatgtacacaggatagagtccttgggcacctcttccccaaccctgtgtgtttatgctgtattctcttttcaagtaaatcctaagcctcggctctttaaaagccgctgtatcatcactgagtcagtgttaacattgcaatatcttttgcacagaggattgcagaaaataaacttaattgacacaggctagtgctggaggattcccagaataaggaactggggttgatggcaagttcccaagccacagcctagaccttccaactacccagggatctagtgccctgcatgtcacctgcacagagatgcttcctggatgctgccacacccataagtaggcacagcaaaagttttgaaggccacctgtaaatgcctaggtgtaggtgcatatcttctctctcctggcctctcttccctcccccagactactcaagctgaacactagtagccctatacacccctataccgatctagctgccattgcctggagaatctatttggtcccaaacccagcacagaggttgagggtagatggcagagactggaaacaactagggacatggctgagatcttggatcactgagcaggcagaggagggagagggtggagaggtaggatgctaacaccctctagcgtagagtatgagagaggtagaactctggtcccccgacagatgagctcccctggaaaggagacatgcagcttggaacagaatactcctgacagggtctgacaagacccagagaatgcagaggttgcagggcatcttggacagccagctgctctggcaggaaaaacacagagtgcaaccttcctatcacagtctaagcatagccggattgttcctggtggagggtgcttaccaccaaggcttgctcctctgcagtcacccttcctccctgtggagctgtcctcagggactcttggatctggagtatgcttgcccagagcatcagaagtgcacctcccgctcacaccacaccttactatcctaaatacgtacctcaagccaaagttgctaacgagcttggagaaacgggtaaaaaggaagacagtggtggcaatgaaagagctgagccagcaaatccaagaaactaaatgccggcaggaaaggctgctgaaggacagcaggcagctagtccaggaaaaatactgtgtgcaggctgaaaaccagcttttcatggaatacctgtgtaaaaataagggacagtgtgagaagaaacaggaggagctgtagaagcagtacatccaagaatgtggcgagatagaactcgagagacaagaattggcatccagacacaaccagagaaacgcagctcttcaagcccagctcctgcagggcagaaagacccagaaggatttgaagcagcagttgcaggcactgaagccagtttacaagataaagaagggccaggacgtgaaaatacagaccttggagaaggagcaagagaaagtccgaggtgagactgcgatcaaggaccaggaggcgcacttccagttcctgcgggaaaaggcactgatggagaaggagctggaaatcaacaccacggggcttgagcttctgaaacctcaaaatccactcccaaagacatacttcctctaactggactgcacctactccaacaaggccacacttcctaatagcaccactccctatggcatagactgtggtctttgggtgtaggtataactttttctcaacctactttactaagggttcaacctcctctctagcccaccacccacaagaggtagtggaaaggaaaagttattaggacacggggggaatggatctgcttataaatagttctttgggggagggtccaatcttcattgtcagggtatcagccgttcagtcctcaggcaaacaccaacatgaaccagcagctgcaaaccagtccactcagcagacaccacacaggaaccagcaagggcagttcaactcagaagaaactgcgaggctcaccaaccggcccgagtccaccgcagaagtggcaagaaagccgcaggaacctcaggagactttctttggtgagtttctctttatgatgtcaccacaagcaaagcccaacaaggcaatgtaaggtgaaccaatatgtgcctgccatcagcaaagaatagcgaggtgaagcaaagtgaaccccaatgctggagcgcccactgtctctgggggtcatatttatattccttttaaacatcatgagtcttctcacatgtctgctatagcaaaacatccttttacctgtgcctgcttcagcaaaacatcctttcacctgtgtgccccagcaaaacatcatttgacaaaactgattttcctaagggaatcatttttatgcaaaccaccactggaaccaacttcaaacctagtccaaaccaatgaaaagggagctggaaactgaggcacagagcaaaaggacagggattaaactaatctgtgccatgcacccactgctataggctcccagaccccaggcctgctgactcactgctgctggctgcttgctgattgcatacattactgcattcttcccctgagtgctccctactggtgaccatgcaggaatatcatcatgaccctaactggtgcctctgaggtgggtacgtgggtaagagatgaatgaactgcaggcaaacagctcttaccttgtagctaaagctagcagtcagagagcactgattcccaagcaagagcctggtgctcagggttcccttaaagccatacagagcgtgtcaatgaaaggatgggtaaaaccacagagaaaatgctgtctgccttccctgatcactcaccctgagaattttgtgttgtttgcttttgatatttaatccccttcttattcatacaggttctttaaacattgaaatgtttgtaactctttagagctacttacccctggaaaagtgtgtgtgtgtgtgtgtgtgtgtgtgtgtgtgtgtgtgtgtgtgtcttggcagaagtggatggcacactctatcaaatgaattatttttgaaaggaattcttactgagctggggcaggggtaggaaagccacaggatggtccttgagcctggcagcatagtctcttgctacccccaaagcagggtagctatgacgtaacctgcaggaaggacaccatgaagggctggggctgatggttatatcagacagttattgtctctttacagagtgaaagtcctgtgtctttccaagctcctctgtagctaatcagagcaggaaatgaaaaggaaatctgaaatgttagctagctcttcgttactgtagcaaatacccaaggcaatcaatcagtttacaaagaggaagggctcatttttttgttcctagttagagatgccttgagtgcctgattcgttgggcctcactgttttagggcctatgatgagataacatgtcagaggcaagggataggaagaagggactgagtctgagatcccctccaaaggcgcagtgacttagatctcccactaggccccatcgatccaatggtccaccacacactggagaccaagcctttggcaaaggaccattggggagcggggacacttaaaatccaaatcatagcatctgctgaggcagcttcattcgtctgcctcctgatgtagattgatgtagagagaatgaggagtggatttagcagaatcaatgacaccccccagtcctcacaagaacagtgtggaatgggcccactagaaaaatatccaaacatgcaaaatgagacctatgttttggggccgcttgtctatcccttcatccaatctctggacttcatcttaagagctgatttatactgatgggatatttctttttctggattgaaaacaaactcttgagcctgtgggctcctttaagcctggaacaaccgagtgaatggatggctgcatacagcccgtctgggtcagctgcatggccagccactgtggtatttcttttcctattctaacataacaaagggctgactaagctaggaggggaacagagccagggaaggagactacagccctacagtattttatgggaatagtataaattgtggtcatctaaaggaagatttatgcctagaatttacaaggtaaacagaatcacccacaggaaggaaaaggacagattttcaaaccccagaccttctcttccgttttcttagctgaaggagaggtgagctggtgggcagacattgtgaggatcttgctgtaaactttacattgccctccccacccccaaaacacgttgaaagctccccatccctctttaagataactgacagttactctgagagaaaggaactcacaagctttagtataagggggctaaaatcacccagggttttgggttcaagcatgtgccatcctgcccaaggtgatgacagtggccgtttcttctcaggagctgtaggaaggaagctaggaagcctctagctctgaacagtattcagcaagaccattaacatttctgagcatcccatgattaaaataagaccatgttagatacttgcacagctgtgtggtgacataaaaggggatcagggaagaaggaaggaggagggaggggaggaggaggagaaggaggaggaagagaagggagaggagaaggaggaagaagaggaggatggaggggaggaggaagaggaggctgttggcttatcctgggtctacactttcatttgagcctgtagcaggatggtgctttgtggagtcttttgctagcttctgatgtctgctagactccccttgttcaaattctggatttaactgttcttgaagtttgaggtgaaatccggactttgagaaaaggatagtctttttaaaaatttttttattaggtattttcctcattttcatttccaatgctatcccaaaagtcccccataccctccccccctactcccctacccaccccctcccacttcttgaccctgacgttcccctgtactgaggcatataaagtttgcacgaccaatgggcctctctttccactgattgccagctaggccatcttctgatacatatgcagctagagacacaagctccaggggatactggttagtttatattgttgttccacctatagggttgcagatccctttagctccttggatactttctctagctcccccattgggggccttgtgacccatccaatagctgactgtgagcatccgcttctgtgtttgctaggccccagcatagtctctcaagagacagctatatcaaggtcctttcagcaaaatcttgctagtgtatgcaatggtgtctgcgtttggcggctggctgattatgggatggatccctggatatggtagtctctagatggtccatccttttgtctcagctccaaactttgtctctgcaactccttccatgggtgttttgttcccaattctaagaaggggcacttgatctttgacaagggagctaaaaccatccagtggaaaaaagacagcattttcaacaaatggtgctggcacaactggcagttaacatgtagaagaatgtgaattgatccattcctatctccttgtactagttaacatgtagaagaatgtgaattgatccattcctatctccttgtactaaggtcaaatctaagtggatcaaggaactccacataaaaccagagacactgaaacttatagaggagaaagtggggaaaagcctggaagatatgggcttccagggaaaaattcctgaatcgaacagcaatggcttgtgctgtaagatcaagaattgacaaatgggacctcataaaattgcaaagcttctgtaaggcaaaggacaccgtcaataagacaaaaaggtcaccaacagactgggaaaggatctttacctatcctaaatcagataggggactaatatctaatatatgtaaagaactgaagaaggtggactccagaaaatcagataaccccattaaaaaatggggctcagagctaaacaaagaattctcacctgaggaatactgaatggctgagaagcacctgaaaaaatgttcagcatccttaatcatcagggaaatgcaaatcaaaacagccctgagattccatctcacaccagtcaaaatggctaagatcaaaaattcaggtgacagcagaagctggcgagcatgtggaaaaagaggaacactcctccattgctggtgggattgcaagcttgtacgaccactctggaaatcagtctggcagttccgtagaaaattggacatagtactaccagaggatcccgcaatacctctcctgggcatatatccagaagatgttccaactggtaagaaagacacatgctccactatgttcatagcagccttatttataatagccagaagctggaaagaacccagatgcccctcaacagaggaatggatacagaaaatgtggtacatttacacaatggagtactactcagctataaaaaagaatgaatttatgaaattcctaggcaaatggattgacctggagggcatcatcctgagtgaggtaacccaatcacaaaagaactcacatgatatgtactcactgataagtggatattagcccagaaacttagaatacccaagatacaagatacaaagcacatgaaactcaagaagaacgaagaccaaagtgtggacattttgccccttcttagaattaggatagtcttttatgaagcacacctgtgctgggtccaggccccttgtttcccatttctccatctgctgcctcccagacaaaagccaccatgcttcatggaagccctgaccacctggcttcagcacctccctgtgtagtagacgggagctcacaggagctggagtctcgctcttcaggggaaatgtgatgggaccaaggactgccctgtgcgctggatgagaatccaaggaggttaaggaggagaaaacggaacaataagagaacccgctgacaagtctgtcagaagagggagctgggctcagaaacttactgtctggaatccttagatcttaaagaagggagggaactgagcctgttgtaactgaattgagtgacatttctctttattaaaaacttatgaagcctggcagaaaaggtgccaataaaagctgaggttctcccctcttagttatttacttttagcagtttgtatctagactttcaaataaaggttggtcggtttgtctgtctgtctatctatctatctatctatctatctatctatctatctatctatctatctatctattgtctatctatctatttatctatctatctatttttgggtaggcaaatgcttcttatttcttcaacaagggatactgcttgctgacatagttatttaaatataagtgtatatatagatacgtgcacatctttttagaggtatatagtgggcacacacactgtattgtacggacatgtgttgagtttggctcatcagtggggtagaagggggtgggtaaggagatgtctctctcactgggctagagagaagcagtggctacagtttgagtgaccatcctttgccctcctcagccctgaagttgcctagcatcaatgtctgatcctggtgtagccatgtttccctgactctcctgcactcctgtgctgtgacccacagggaatgttactcagagagcgccaggcagggatgatccgcctggacttgaagctgccttgcctttcatcttattaaaattaagccattaactacctttaatgtggaggttttgtggcttaattttctttggtggcatccattaaaaacaggggtgggtagcacaattgactggcagcatcttcagacatttagtatgtattattaatattcacatgtattattaatattccctacctgtactgagagctgtcatggttcagtctgagttatccccagagctataatgaaaccgtgtgtgtgtgtgtgtgtgtgtgtgtgtgtgtgtgtgtgtgtgtgttgtgtgtgtgtgtgtgtgttgtgtgtgtgtgtgttgtgtgtgtgtgtgtgtgtgtgtgtgttgtgtgtgtgtgtgttgtgtgtgtgtgtgtgtgttgtgtgtgtgtgtgtgtgtgttgtgtgtgtgtgtgtgtgtgtgtgtgtgtgtgtgtgtgtgttgtgtgtgtgtgtttttcctgattacctgaaatccagttggggctaaagaatagctcagaacatctggtagtgtcttaaagtgactttttatttcccagacctttaaagctgccacacagacttgtaaacgtgcacactgtatttatcctgctaacatggaattgtcctcatacgtgtttattttaatgaggtggaaacaccagagacatgtgatggcacacctcagacacagttgacttagacattaacggagactttgactgcgtgtctagggtatgcacaacactgagctaggctccaagagaggcatgcaatccggcccctgctttttaaaagttcaaagtcttacagagtagaagaaaatgtgcagtcaaaatggatgccaaatagtagcttctggatgtgagagatgagtgtcactggcagaaattctgtgagcatgcaaatcagctaggtggcctgataggttacagcatctctctctctctctctctctctctctctctctctctctctctctctctgtgtgtgtgtgtgtgtgtgtgtgttcattggggaaaatatttttagagaaaagatggggagatggagtaagacctaaggtttttcaagacccatttggataagctggagagatgagcgggtgtcccaggctacgcactgtgattatctgacttagagttgtgcagcccaggagactgtgatgagccagacccacatggcattgtcaaccatgtttagatctctgggtaggaggcatttctggagggtgttaagtttggaaggccttgtagagttgatgtttggggaaaggagaggtaaactctgctgctggcatgactaagcttggtgctgctgagcatctgggtcaggtgaacatggaaagaaagccccgtatttaagctgcaaagaattggctatagttcgtacctggaaaagccactgttagtgtggtctgaaagctgtcactgcagctcattttgactctttatctctggaaggacaagatgaccatcttgctacattttataatttcctgtcaatctgtatataatttgaaatcttctctatgaaattttcagattctaatttccttctgctttccaaacaaagctcatatctccatctttctctctctcccctcttaaatgtatatatataatgctagacttgctcctgcttagctggaggaacaagaggtgtcgctcagtggtcatgagcttgtttgggacgtaccaggtcctcagttacatctctgtctttgcaaaaggaaaaagaaaaatagaaagaaaggaaaagaaaagaagaaattaaggcagagccctgacattgttttctagatgtattgttaaattgaaaatgccttgtattgtttcccaaatgtatggtgacactgagaaattcttctattgttttctcaatgtattgttctgtattcaatcaggacagtatacaaaaatatgactaactcaagactattccacttctcactgttaatcttaaactcatgtgtctacatgtattgcatgttgtatgtctatgagtacacactgtgggaggggtaagcaagcatgtgtttacatacatgtgtgggggctagaagcaagctcagtgtcacttcttaggtgacatctggcttttatttttgagacagggcctgtcaccagcctggaacttgctaaattgccttgaccagtgggttagggagccccagggttctccttgtctttccttcttccatatagggattataggcacacacaccatgtctagcttttctattaacttttatttttatatttatttattttgattttatttcttattacctgtgtgtgtgtggggggggggtcaggcttgccacagggtggaagtctgaggacagcttttggaagtccattatcaccttccactttatgtgggttccagggatcagactcagatatccagatgcacacagcacgtgcctttttccactgagccattgccccagtccctgactgtcattttagattcttgattggcagtggactttgctaataaaagtcaaggaatagaagtcaagtcaatagggacagctgtgttgacaaatattattactgtgtttcaatgtatatcttgttaactcgattttattttcctgcactgaaatatgttctcccatggaagacagcctgtatttattagtgacttcctgtcttggcagcccccctgttgcctcatgggggggtggcttttctctcagcatatgtaatattcacattgattaattaatcgattagacaagtgtttattgagcgtgtgccttgtgtttggcataaatccaggtgctggagtgcagagggacatgaacagcagggccctgcactccgatctgcactataaaagtaggagacagacagtaaacacaccagagaccatgctacatacagaaatctgtaatggaaccaagcatgcaaaacatgtagggagagcactgtgggccatctctactcctataagatacatagaggtaaccagcaccctgcccatggagggctcatgtacatacattgaatgaaccaatggatggatgcatacgctatcctgccttcgctggcagactgttggctcatgctatcttatcacatcggtattgattatatatatgtagcattttcctttcacaagtggctgtcttaggtggtcttgtttctctggtgtcccttcatcctcctgcctcagataaatcagctgccagtcccttcaaggtgatggctttttcaggagcgcttcctaagccccttgtgtgggccttccatactctgcggatattattgtttaggtgtctatgtctttgtctaaatgaagcctcctccatggtcttcacacagaaatatatgcctctctgttgtggccaaacacatagaactgtttgctgtgaaacagaagtcaccatgcctggccatttgcctcatactttataaagaaaagaagttctatgtgttccacaattatagatgctaagatgttcaaatagcatagtgttggctcctggttgcatcatagtttaccacactgtcaccacaccgtgaggcatgctactaggtcatccaagtggcaataacaagtgtcagttataaactgtaatgcccacatgtgctatggcaggattttgaaatattaagtgtgtgggggcacccaagcgcactcacacacacacacacacacacacacacacacacacacacaccccacattgaataaatgaataaacaaaggaataaataaataaatggaaattttaaagatgaataattcatcaggctcataaagctggttcatttcagcattgcttttcaaatatctaggacctagaacttagagggttttcttcctccctctcttcctcccttcctgccttccatcttccatttttgtgtttctgagtttggaacctgggtccttgcaggtactgtgcagctgagccatagccacgcccagcatgtatgccttctgcgtgtcacctctcatctaagtccccctttttcccaaaagaaaaccaaatatagttgtctctgaatccacaggcttcatacccatggattcaatcaaccctggatcagaatcttcagaagaacttggtctcatgctggtggtgacagactgtcagccgtgcctgtcactactcctaagtggcaactatttacatagcacttacactggattaagggtcacaactaagctggaaatgatttacagtatgcaggataaacaggtcctttgcaaacactgtcattttataggaaggaactttagcatcactgttagtggtgtccagcatccacaggagtaactcagtctcatgtggacagcaagaggtcactgggctttgctttaaatactcatccagatggcacataggcacaattatgaagctgaagacacaggattcatgcattcgttcaataaatatttttcaagtattccctgtgccacataaggctacagcatctgaaataagcagactactttttgtaaggagcgtggatgtaatgtgggttggaatgggaagaggtggctatggaatgtgcacctcaaacacaacaaagttactggagggtgcatggtaggttgaaggtgataaatactatggaagaaaagacacaaagtgagcaaggccaaagactggggtgggggtgtggtgggggtgtctctgatctcagctagctacagaccttgtgaggaacactgactcaacaacaataacacaaacaaaagaaaaacaacagccaaaaaaaaaaaaaagagagagagagagaaataaggtggaattctcctaaggaaaacatcaggggtcaaattctatctgccacataaatatgcacacacacacacactgacacacacaaagtcatgtacacacacacaccagtatgtgcacacactcagatatattcatatatacacacagtagcatatgcaaccacaaacatgtatatgtacatgcacatgtacccacacacttgggcacgtgcacatacacacacacacactacacatacacaaatatcacatatcaccatatataccctttaagtttagacttcagtagcttttagtaaattctgttttgtataaacatcaccattaattccagaatacttatatcactcctaagagaagtagtctactttacaataagtcactccatcttttcctcctccgatccccctaccaatctcttatctgcatattccatgatggttctatggactggtctattctagtcatgtgatggaatcatgtatgggtttctgtacatgcattctttttcttaactgtatggtcccaaatccatccatattgtgacctatattgctaattcattttttatgtctttgtaatattccattgtgtgcacataccacacattgcttgtctatttatttgtattgaacattaggtggttatgctttctgccattaataatgcttctgtaatggcagggcacaggtttttgtgtgaatgtaccttttaatttatatagtatgtatcccggagtggaaggccttaccttcctcctcacatgaagtggaagccatagcaggtttcttacctgttctggccttcacactaggtgtttcctctggctgtgcagcgagtgaatgcagacagtgggtaggtaataatgagtggaaatcagaccagttaggagctgattgcagtggttcaggtgagaggagaggtctcagaccaggacaggagctgtatgtgcggagcatagtcacatttgggacatattgtaaaggcagccaggagagtttcttcttagtgaagtaaaagtgggcagggaggagctaaggactttggctccatctgctagaaggaaggggcagccatggagtggggtgagagagccacacatgggctcaggagttccacttgcatagaccaaggttaagatggtcagcagacatcctcagggagatgacaggcaggcagataaatgggtctggagttcaggaagttgtctgtgctgcagatataaatttgggaatctctggcatgctgatgatatttagaaccaatgaggtagagtagtcactgagttcccatttgttttaaagggacaaagcagcctgctcgttgatagagttttagccttttctatgtactgagttccaacgatgacctcatgttatgaaaacatacattagagagaaggttctctctagagaatgcgattccaacatggttaaactaccggcctcagggcataaattagaggatttattcatttatatattagggccatgaatcaatattggattcagtatctcatggtattttctaactgattttgagggatatatatatatatatatatatatatatatatatatatatatacacatacacacacacacacacacacacacacacacacacacacatatatatctgttgtctgcttccacaccagcttgtgatcagtatacaaaggagagggaatcacatttggttttggtattaataaaaaaagcagtgaactcacataccattagtagacatgggatttcctaataccagaagtggggtggtatttgaggccagagataaaaagaaaaagatctgttgtgtataaggaaataataataaaatcctgaatgagctgaagaaaaataaccatcaaagacaagagagggcatgctaggggagatggcacagttggtaaggggcatggggaccctcatctggtccccagcactcacctgtgaggagctggtgcagtggctcacatctggaatgctgctggtggaggaaggggaacacagagactggcaggtatctgctcggctagcccagctgaactggagaactccagcttcaatgagaggccctatctcaaaacacaggatgggagtggccacggaggacatcagacactggacgatgacctcagcttgtatgcacactccaacatgaacataggaagcatacaaagacagaaagagcctggattgtccagcaaccacatcagggaggaataactgaagatgtaagccggcacagcccaaggaagactggatacaagaggagtaggaatttgattcagctgtatgatactttatcagttgtgtccaacctgtgacctatgggcctcatgggacccacaagagctgtgcacatggctcaacacaaagtcataaacctagaacagcatgtggtagggtggctttatttatttacttatttttgcattttttaactcactgtacaatcattgagcatgagcccacatacaaccaagaacagaagcctgaatctacaatcccagcatacccatggagaggtgagggcagaaagaagcaggtcatggccagccaccctgctgcatacagtgacaagtgactagagagcctgttgaggaggtagaaggttaaaaccaatactcaagattatcctctgactgcacacatgtgttgtggaatgtgtgagtgcgtacacacacacacacacacacacacacacacattttaaaaggaagctagctaagatgacaggctgaaatgattcctacccttgtgaaaggagatgacattgttgaattattcctaagggggcatgaatacctctcaggactaaggcgggtttacctccagcagatacgtagtgcttatggttccagtcctcagaagagcataccagaagccatcatttctactcagctctgggaaacacataatagtttttcttaaaataagaccacaaaacacgatcaaagggcatctatccatggttatctttgaaacatttctcccttggagaaagtggctgtttagagccggcactcaaccacgtggttttctcccttatctttactgctgtatggatctctttgtgaccagtggctggcaggggcctctctgcccgcagcaccagcctgactggcacgagagtcatttcaggttctgttgccatgtttcagtcaatctgtctagagaacagtgacgctcctgaaacactcagatgctctcacatgtcatgcaaaaggacaaaggacaatcccaggttctgtgtttgaactatcccccagggaaagtaacatcactatttggggcccattgatgggagcccatctgtgaagtgggaaccatggcagattctccagagagattcctgtctctttccccacactgcagagacggatgtgctgaccattggttcctagtcccagacttttgatcttcacaagaaaccaataccattgaattgtgtcgttccctggatcatcagactgcctgtcagctccccacagagataagaaagagatcttgccacacacgaagacagatgtgaccaagtactaattattatcttcagaggtgaatgcaaatgtcaccattattgagcactgagatttattttttcctgaactcccaagagcctctgagctggaatctggccttcagaccttgacagatgtcctctgctagtctgagcaggttctggattgatgtgacatcacgtggccatcctccctcccccccccctctctctctttgagtgctacagcagcatctgaccaaatgctgctcactggggaaccatgtgtgttttttgccattcttgccaatgaagctcatagctgagggagggagagggagaggggagggggagggggagagggagacggggagggagagggggagggggagagggagacggggagggagagggggagggagagggagaggaacacacaaatgagcaagctatgtttgatcccacagtaggtacacagagtgagactgcttagcaggcaattcagtgtgtgtgtgtgtgtgtggggggggatactcagttttaggacagaactttagactaagagaaggcatagctgggtagagagggggtattggatggactctgcagagacctcgatttactacttgctctggaggcccagttcctgtgttctccacctgcctcctgtcttgctgggtcttctcactcaccagctgtgtgggcgtgtcatggttcacggttccaagggagctgtgagcacacatgtgacccctgttgttggtgaagccatatgggcatgggaatgtgagccgtcatcagttcaggcagggttgactatgtcccattcaagtgcaggaagtcacaggggcagaggctgggacccctgttctcataccccatgtttataattgcctggaaagtggagaaggacgtggtggtcaaaactgtagaccacctattctccctgcctccatacctaggtctcagggagtttgcgggtacttgtgtctgatgttcaatgtagactctgggaggctgatgacaagaagctgtgtcagatccgactttgataaaagtaataactagtaatgaacctgcatagagtattagactcaaggcaaaggataaagcagccacctctctgctctggtctcatgggacctaacagtgccgtccaggaccgacatggaagcggagcttagagtgttgtaggtgtttcactagagtgggaaacgttttccactgacttatgtctttgaatacttggtcaccagctagtgatgctgttttgggaggttgaagaacctttaggaggaggggtcaggctgcaagaaacagttcatcagggacaggtcttttaggttataacacaatttagctttcagcatgtcatctttgcttcctgactcctcaggatacgagtgagcagcttcacactcctgcctccatgcatccagctgcttgggttacttcaccttcccgaccacgacaagcacgtgccctctcaaaaccgggagacaaaataaggccttcccctgataagttgtttcctgtcaggtgtttggtcatagaaacaggaaaagcatccaatatagttgtttagtactacagtactataaataaataataatgaggtaaatcaatgtataaagatgagaaatttatttcagttcacagttttggtctgtggttggttggtctcatagcatttagacttgggctcaaagactcgtccagtgccacctagctggaactgcagttcaggtcttcttctcccaagaaccccagttccagaagcctcacttttgacctggattcctgtacctgtgagtaccacaagaagttactctaactgaggggatgtgtgtggtactttgaatgagacatggtcctatggatgtgggtagttggacattcagtttccagttggtgatgctccaggaggcatggccttgctggaggtgtgtcacttggggagggactttgagattccataaccgcatccttctttctccagttttttgtctctaagttgtgtttgtggttgtaggtgtggtcttcatgcctgctaactgcagccatggcaagggtgttgctcagcagtagatgtttgcttaccatgcacgaggctctggctttgatttcttttttctccaggtattattccttctctaactgcacaggaactttttttcctcctttatattttctttccctggttttatcttaataccccctgccttcccttcctttgcaagtgttaataagtcttggatgtgtttttactcattctgggactaaatctttttcaccaaagaaagagctaatgaaatgtcccaatacacatctgtgatattttagcaatgcagataagatctagaaactcaagggagctacacaaagcttttcatgtaaagttagtggaggcaaacggccacacgagtcacataaaacatcttaaccattgttagacagacctcagagccctgtaaggaggccctgagtaggtccttgggtatattctaaggtgaccagagatgctagccctctgtggagttcctgcaatggattcctccctggaatattagactcatagaatatagatgaagagaaaactttacagcaaaatgaatccaattttggagcattgttagagactaacatttgggatttgttccaaactgtacatttggaaatcattccagcagtttggagtcttttatatttttaatactgtgggccattagctgctcttcctcttcctcttcctcttcctcttcctcttcctcttcctcttcctcttcctcttcctcttcttcttcttcttcttcttcttcttcttcttcttcttcttcttcttcttcttcttcttcttcttcttctccttcttcttctccccctctccctcccctcccctccttcttctcctttttcttcctcctcttcctcctccatttcctcctctttcccctcctccccctcctcctcttcctatttagccacagaaaggagggaagttcttacacatgctctctcatggatgaacctgggagacatgatgatgaaggcaggtataagagaacaaacatagctgcttatatgaggtacccaggttaggcaagccatagatacagaaagcagcatggtgacctccagaggttggaggtagagagaatggggagttagtattttctgagtaacagagttggagcttggaatactgtgaaggtttggaactttacattggtaaatgttgaataatattgtgtctacatctaataccattgagtcttatacttaaaatagcccatggcaaagggcctggtgcatatgcactgatacatgtacattaatttttaggaggctacatgtaggtctggggagatgcctcagttggtaagtatcttacaatcatagttcccagagccaatgtaaacaaatgttcagtatggaggcatacttgcaatcccagcactggggaagcagagaaaggtggacccctggggctgggtggaagagacagatggatcctagcctgatttaaaatagaaaaaggtggacaccctctgagaatgtacagactctcccaccacatggatgctccacacacaggactctgaggagaacattgaggggttggagaccctgtgtggccatatcctgtcaccacagatcctcagaacaagacatcacagtgatgccctctgtcccttcacataagtgggactgacatttgctccacagcttcggtgaacaaatgaaggaagaatacagatgctgtccagcaatgatttgcatctcaattgataatcgggctggctggctgtaacattcttctgcacggtggcctctccctgtagccatcattcttaaatgtcctggcatttatgaaaccagactcctttaagacaagacctgacctttcccaacggagcttcaagcaatctataggtactggttaaaaatagaaaatggtgtgctttttcaggggctaacataggcaaagcagagagagggtgggtgcagtcaagtctgtctgtttgagggcttcttctgcaatgcctttccacttgttcctcccaaccattcaggttcaaaccacatcactaaacattttatgaattcagtgaaaacctccacaaaaaggctcttgcctttttaaaatgagggtcatatttggaggaaagaaaaacatctatcaatttaaaaaaatttctaggaaataacttctggaaaaggattagattgagcaggcaagtccaaatgaaaggaggtaggggagaatgtcatatgtgataacataggaattattttcatttagaacttttatacatataataatagtatacacaccatctcattaaatgctcccaacaacccagcaaagcagctacccttctgtcaaactaaaaaaaatgaaggttggcttcttcaaggtctataggaagaagcccaatggcccagcatccaaggtcctgggcctgggtttattacttgtagctacttctggataattaacctccatgactctatctgcctgtggcatggctctctaactgtgaataaatgatagcaaggacattctgagcccctatgaatgtgctgcttttttgtggagatcatcatgccacgttttcctaaaatgatgtggggggttaaattgacagatatcaaaagatttaatgactcaaaactacctaaaaaggaccacctacaccgttttcatagtttatcccaggaataaatgagaggcaaggtctttgcttgaaagtgactcggagtcaacatagcaacagggaagtgttcagggagtatggggtctgtgcagcaactgccactagcaaagaagcaagctaatcctgcaggttcaggcttccatggtttgctttggttggctggctttggcccgacctactcccttttggtagcctggctctgtgcttattaattgatctcatagagatgatgtatcaaaagaagaatagtttctggtcctaaggtttaaactctcttcttcaacctatttttattttttgtgacttcatgtatactaggcaggttctgtaccactgagcgaattaacctgggtggataaatcagtggtaggtagataaaaagatggatagatggatggatggatggatggatggatggatagatagatagatacatagatagatagatagatagatatattaatagataatagataggtgacagttgcttgatagatagaagaaagatagatggatagacagatgatagatggacagatagataaatagatggctatatgatatatagaagaaagatggatagatgataggtagatagatagatagatagatagatagatagatagatagatagacagacaataggtagaagaaagattgatggataaatagatagatagacagacaggcagacagtcaaatatgtgacaaatgccagataatagatgatgtaaatagacacataaaaagacaacagataattggtagatagattatagttacatggggatagttcagtagcatgtagtgctgcatgctaatgtggtgctctaccactgtcttagtttcttttctattgctgtgaccatgcaaccaagggaacttatagaagggagagtttaattgggcttacagtttcagagagttggagtccatgatggcagagtaaaggcaacacagcaggaacagatgagagcgcacatcttaatatgaaaatagaaggtgtgggtgggggtgaagaggagagagagagagagagagaacaaagtgctattgcatttgcatttcagacactaaactcagagggagggctggaagaggttaatgttgtgagtgagtggttaatgaccatgggtaagactggctgatgcatagtacactgatagtgctcctttgtcaggctattctcaaatgaccttgaccctcctctcagggggctcactggactccagcaccccaaatccttgaaatggattctgtccatttgtatggatagaaaagcaaactctcaccttctaaaagtcactcacgtgagacatgggacagacggtccacattatggcagctatgtagatctgtgtactgagggtctaggcctagaccacttgctgttactgtaatctgtctattttgttagcttctgttactataacagtttataaagagaagaatgttggttttggctcacagttttagaagtttctatttgtgagttcttagttgtatttcctttgggcttgtgacaaagagtacaaagtcattcacttcacaaccaggaaccaaaaaagtggatgaagagatcagaatctcacagcccccttctagggtaccttcactgtgacttgaagatttcccactacaccttgactcccagtggctccatgtactatatgtcccaggagtactaagctggagatcaggcctttaacacgtgggcaaaccctagcatcatgtcttgaactaacttaatacagcatagtcccaagaagccatgtgaatctatgcatccttttctctctgtgtgtgtgtgtgtgtgtgtgcacatgtgtgtgtgtgcatgcatgcacgcaggtgtgatcatgtctggagatcagagaacaacttttaatgttggtccccaccttctatattgcttgagacaaggtctctatttttccactgcatacatcaggctggctagccatgaacctctgagaagcctcctgtctctgccttatatcatcccacagtcattgctgggattaccaacatttataatacatctctggttcttatgtaggttctgaggatttgaacttacatcttcatacttgcacagcaagcaccttttcccagagagccatctatctacctctcctgcatccgttttaaacccgagttgtagcaacattgttgaaattgcaggtacatgcaacataaataaacatgggctggactcatgaagcaagtaaaggagagtccttggatctcatggacttgacaccatattatccattcaaacttgtaagattcgtgatcaaactctggggtaaaaacctaagagtgccaaactatgtaccaggctacagtgatcttgagatgtcctgcaagtgtgagctcagccttttcttcttgaaagaaggtcagatttggtgtagttcagacatagcactgcctgtcccagagactttagttgtacatatgtgaagtctaaggagatcagcagcaaaaggctgggcagaagggtcaggatataagagtgtggcttagttcaactgtaccggaagtctgagatgatacacatattcttctactactactcataatagctaaggattactgagtgtgcggaacacgcccagcaccttttcctaaaaacttcatccgaattatctcgtgtaaatttttttccagccacattttaaggttaatctgcacttttagagccaagtaccatgctcagagcagctcactaataaatgcctaagctgtgcgcgagactttctctctctctctgtttgtactctaccatactgctctgtgcctgtttgcttcatggtcgggaatgataaatcagtctcacttccttgcctcctacaatcagctcttggcctgtaatctgagagatggagttggtaggaaatcatgatgtgaattagttacggtacatgcagtaggcagagccagtatgaaggaatgaaaacaggacttagcagtcccatatcagcttatcctcattctgtccacagggactcctcggctacagaggtttccataggacctatttttattactaggccatatttgtatttctagcctgtcagtgggctactagttaataaaaagcagactgtttcatattagagtcttatcaaaagcagcacctgtcatccatcagtcccactttcagaggttttctttgtcaatattgagtccttagaagatgacatatgtgatgagaaagatttgagaatacacgagaagtattgtctgctgcgtttatcgtggtaagtaaacctttgtgttaagactctgaacgctggggctgtggaggttgctctgttgcaaagagcttggtatgcacaacggcggaagttcaatcctcagaacccacttagaacaatccaggtgtgacagtgtgtgtgttccagcaccggggacatatagacaggtgaatcccttggactctatggccagccagcctaacctaacaggggagatgtagactactgagagaccttgtctccaaaagcatggtggacagtcactgaggaatgacacctgagattgttctctggcctccacatctgtgtgcacatatacctgcacatctgtgcatacatataagcccccccccacatgtgcacacccagtaaatttacacatgtaaaccctgagtgttgagtggctacccaatattgtaggattttgtttgttgtttgtttgcttcttgatttttgaatctgccagaacagaagaagtaagcattgtttggaactgtctacaatgttttcaagaaagtcagagcctccacattctttgtgttttatagaaatctgaacacatttctaactctgctggacttaaggttttgttttattttatttattgcttagattggactttgtcccatgagaaaccactgggcagatttaattttgtgcagtctctcttttgagacagagtatttattgtctggcaagattatccaaaagaaggaaatgagtttcaaccagagatgggggaacccaaaacgttgaggtcagagctaacatataggtgcctttgtcttgctgacatcaatatttttgtatttctcatctagaaaggaaacagctaagtattgatattttagaatgaaaacctctccgttttattgactgctgttatattctgttgttctgatataaaaatgttgtttgctggggacatactgctcatctgtgtccaataccacatttgtcattaccacagtctaacttggtctagggcacaagagcaagcctgagggagggttacagatggaggagccgctggcttctaagcatgaggactcccaatgcaggagagaagctggggagcccaagctggctggtggattaaatggtaggctgcattctagccttacctcccgatgtctttggctagtactcacaacatttctcatgatctcagtttccttcactggacacatggacttgaaaaaagatctctaggttccagccaagtctggagtttggagtttgtgtgagactacatcaggccctttctgaggtatctctcctccatgtgtggcaagggagcagcagtgtgatcttactctgtgctccttaggtccctcccctctgtgctccttaggtccctcccctctgtgctccttaggtccctcccctctgtgctccttaggtccctcccctctgtgctccttaggtccctccccggagctcttcctctgagtcccccaatccaagctctttgcttaaatttcgtttaatccctttgtagtggttagagatgccactctggcagcctttctgctttctctgttttgttttagaagagtttacattctatactctttttttgttttaagatgatatttacaagctttgcaagctgcctatggatggggtgggggtggagaggggggagagagggagagagaaagagagaaagagagagagagatccagttatcttaaatagagtgtcagttgccaactttggtgggagggtagggggtggcggagagtgtcttcagtagccttagtttctatatgtgtacatttaagtgtatagaggaaagtgagttaagaattggccaagctataacactttatatgtctttaaaaggaaagcaaagatggaaaagtcactactgtggccaggacaggttcacaatgacttgggaagcaaagcagggttttccaagtgacttgtgcccatgtggttgcttgcagttactctggggaatatgactggcttctcatggtttgaggttggagaaactgtgggttttcctttttaaagccttgtatgtaagataaggaagaaaggaaggaagaaaggaaggaaggaaggaaggaaggaaggaaggaaggaaggaaggaaaaaaggattgcaccacattaaccacattaaagtatatgcaagcatgtgtgttaaccatctgatagaaagtgatgtaatccacttcataaaattggtgaagtagcacagccctgcccttctaggcatttccacagtagttttcattaaaagtcacactccagggccttagcagataaagacagttgctgacaaagaacctgagattgattcctagactcgatatgatagtcttgggttggcttgagtcagtcagtctcatggaggctgcttgtatctttgtaattttattttcaattaaattagcaagtataccagctagaattcccaaaacaggcactggaaaaagacctaagttacccaattgaatgacataaacttttgagtgtctatgattggtgtgttcaagataatagatggtagagtgaggaatttcatcagaaacctgacatctggttttttgtttgtttggtttttgtttgatttttaaagacaaacaagcaaattggtaattttgtaacctaaaaaaaaaagaaagaaagaaacattggttagtgggaaatcactagacaaaccccatcacatattaaatttagtataagatgaaactggtgaaatggaagatagaccagtagattatattcatgtaaatgcattgagcaaaaaggatggggaatttgacgagaagcataaaagacacatgggtcatacttttctccacattcaaacatggagccaaagtctgggaaatagaaggtgagaccaatacagaagtgatattcccaaaagctggtcaaaaccatcagaagataaattcaggaagccttgcctatcatctccagagccatatgtagaagactgtagcaagcataactaagcctgacgaagacaaaagccaaaggggataatcaatacagcattgaggagacaacactcttttcatggaaacaacatgggactgatcacttgcttcccagcaaaagtggtagatgctgagacaataggatgtcatgggcatgttctgtggggtgtactgctgactgccagacacacagaagtatgaccgaagtatttgtcaacacttgaagtaaaattaggacaccttaaaccaacaatttcaggaatccactgctgtagagcaaccctaaatgaaataggaacaggaatgacacagaagggaaagatggtcccacacactcaggaagaatcaagtgacagatagggtgaaaatttgctgggctaggaaacattggaaataaaatgtgtgttgatggttgtttgtgaaggcatgaggaggtaggtgaaaaagcttgcaaaaaaaaagctccttatgtgagtctacatcacagctcctggatttgtggctcaggaaatgtactggctagttttgtgtcaacttgacacagctggagatatcacagagaaaggagcttcagttgatgaaatgcctccatgagatccaactgtaaggcattttctcaattagtgatcaagagggaaaggccccttgtgggtgggacttatctctaggctggcagtcttgggttctataagagagcaggctgagcaagccaggggaagcaagccagtaaagaacatccctccatggcctctgtatcagctcctgctccctaacctgcttgagttccagtcctgacttctttcagtgatgaacagcaatgtggaaatgtaagctgaataaaccctttcctccccaacttgcttcttggtcatgatgttttgtccaggagtagaaaccctgactaagacaggaaacatcccagaagatggggcagaaagattacaggaatcagaacacgagagagtctgcagtaaaaccgtctttcctccaaagggctgcataagcgagaccagaaggatgccaacgttgatgggcatattaacacagaaggggaatttttgcatagtcccacccccagacaaagagctacagggtgctgatggcttccaggagaagtgggattagctcttctcaggaggtgagcccccttattagttgtccaacgtggagtggtcagccctaaaactgtatttgggcaaacaacaaaaatggactcagcagtttgtatccatgcacttgtgcatacatatctatatccatgtgacagtaacaatcaatacaagaaactatcaacttaagagtaagaggatcagaagggcttgagagaggtggctctcaggggtagaagaatgagagttggggatggtaagatcctatctaaggttaaaacacaatttaagaaatttaaatgtaaaccatttatgggcactcactgttgaattcttctcacattgctgttggaaacttatagaataaaatattgagaaaatttactggcaagtagaaataagttttgattatgtaaaacaacaaaacaggattttttgtttatgtagcaataggtttaggaccaaagccatacaaaaagaagagagttaaataaaattaaaacattataagtcatagtaatatttgagtgtgtctaaagttggaattgtgctagactatagtaatttcagggcccataatgtaagctgtagagtaatgaataaaatattgtatgtagaaggtgaaataaaatggaaaatacttggttaatgtaaaaactgcaaagatgagaaaagagaaaaagatataagtagactagcagaaaacaattctaaaatggaaggtatggaaagcaactaaacactccaattaaaatacaattttctgcttatactttaaaataaaatctaattgtgtactcttcataaatggtgctgcttaaagtgtagaacccagagaagttgagaataaaaaacagaaaaaaaaaaaagatacatcccgtaagtatccaataaagtaagctgtatagctctattaatgaagaaaattactataaggcaagataagaaccatcatttaagattaatgaaggcattttaacaataaaagagtcagttaacaagaaatatgtgacaagtccacatttgtatataccctagaacatggctgaagccctatacactgtcttagttcattttgtgctagccatcaaagaacctaggatgggcagtttatacagaataaagatttatttcttacagttctggaaactggttaagtccaaggacagtggcccacatgtgctggctattcttagttttcaacttgactacatctggaattaactaaaacacaagtggctgggaacacctgtaaaggatttttcctaattaactcatttgaagtggggagacccaccctaaatccagatcttttgaggtgggaagatccactttaatctgggccacagcttctgctggcagcccatataaaggacatggaaaaatgaatgtgcatgcatgcgcgcgcgcgcacacacacacacacacacacacacacacacacacgcatgcatgcacacacacacattctgttcctctagagaaccctgaactattctacataaggactttcttgccataatatggcagaagacagaaaagcaagataatgcccttgaggcagacagacttatctctgaaaggcagatgtctcatggcctatgacctactctgcttttgcaggccctgcctctctgttgttactttggaaagtatgtttctaacatgtgaacttcaaaagacacattcaaaccatagaaactattattgtttaatttttactaggctaatctttagactacagctccttaaacagggttcaactccatatgggactccacaagaaaatgtggggggttgcaaaaaatttggcaaaaataaaagatgtctgaatgggcaatgacataaaaactgattcaaaaccaaatttataatgaatcaaggctttctcatagctcctgaccatatttcattgtacaagttccccacagccttggtcttaacacagtgtatacattttgttctgggcaggccatctggcttgcaatgccagagctcacttcctggaaagctgggtttgatacatgcagttgtaatcccagcagcgagggggatgaagcaagcagaattctgggcttcctggccaaacagcctaccctagtcagcaaagccccaaatcactccctcacagaaaaaaaaaaaaaaccgtagaggatacttgagggtacccaaggctgacctctggcttctacatgtatcatcatcatcatcaataaaaaaattctgtttgagttgctggcttgagtcctattaaaaaacaatcattaactgaattctggcctggaatttggactgaagctccaacaatttctaaaatgtcacttctgtcatctgtactaggcattgatgtgaggtggtgtcctcagcactgacaattataaaataaaaatatctatgaattcctggaagcattgagtatgctgtatatgctacaatatcaaataatagcccatatgaacgacgttggccatcctgttagtatgggaatttgcttttgtctttaataagtagcaaacttgcatcaaataattactttaaaataaaattttctatgacctattgctgaaaatctttgattgtagatgtatcttacatgcctatgtacctggggtcgcataatcatttctttggtgaaaaggagtcaagagtagggaagtttaagatccacgattttaagcacttgctaagttatggcatagtgtacttagttctttccaagtatatgttgggacattgactgacattgaccacatgttggctcattaaacaagtgtcaacaaatgccagagggctaactgcattctagagtatcctttctgaccacaaagaaatttgtacatcagtctctcctggtctaacaaaacatcccaatggatctctgagaatattttgaaggtaggtgatcctgacgcctgaacacattcagggctaactggccgatccccctggtgtgtactcttgatcaaggcacctgggatgttgcctactcctctgatgtgaattaatacctcgcctatggccatacgctatgcatgcctcaggaacatgtttttgaccgctgactgtgggacaagaatggaggtaattacaataatgtgttgattcaggtgtgattttcaattaccagataaaaagcaggacttgggtgaagcattttgaaaacagtcattttctcatattatccccatctccaaaaaaaaaaaaatgtgatggtgtatgtaatttacagagatttcaacattcccaaatcatcgttacttgtaaaccatatcttttcatttccaagtagatctctttcctttatggaggtcttcctgggcacagagggagggggtgacaaactgtctgatatactttatggtctaatgttttttattaaccctttggataacatacagactgagaggtccactgtgacatcttatccacgtgtttgttgccatgtgtattagtcagggttctctagagtcacagaacttatgggtagtctttatatagtaagggaatttgttgatgacttacagtctgtagtccaactccccaacaatggtcagcagcagctgtgaatggaagtacaaagatctagcagttgttcagtctcacaaagctagcaggtgaagaagagagagcaaatctttcttcttccaatgtccttatgtaggtatccagcagaaggtgtggtctagattacaggtgtgtgccaccactcctggatctgggacttgctttgaccttgaactcagagatctccctgtcttaaacttccgggattcatagccactatgcctcaagatttccatactaagatccaggtcagaaacttgtgtttccagtctccagattaggatcacaggtgagccttccaattctggattagagttcattccagatatagcaggttgacaaccagaaatagccactacatcatgcttaggtcttcttcaccctatcccctctcttacctttcctccccacttactagtatccaatctgggtactgtgttatatttatgaatatatatacatatatttgtgtgtgtgcctatatattcattcctcatagagaaagcatacagtagtttgcctttcttataccattatttttcctgttcgcccttcactcttcctagacacttccttcccctgtatgtataccatatatgtgtaatgtgaaaatagaagaggcacacacacagagacacacacatacacacacacacacacacacacacacacacacacacacacacacacatatatacatgcaatatatacactatatatattctgtacacaaaagaacacatgtagtgcttgctttccgatgttggcttatgttgcttggcatgacaactgtattctcacgtgttcaagcaagtttacttcagtgcagtcagagatcctgagaaaggagccagagacttctcagtaacctgagtaacgggatctgccccagttatcaaggtcattgctcctgtgcttaattagaagctagtgggatgttatcacttagtctactagcagagagcttccttgaaaggcacagagttagggaatgataggatgaaatagagttaatggaccatatcagagtctgcttacccacaacaaatctgaaaaaagcaagaaagcagagaaagacacagacactgccaaccttatcatatgagtgtgtgtgtgtttaaatctccatggactttcagtttttcttcctttgaataatatagtcattattcttttgctttctttcagcttagggcttccaaatattttaccagctgcctttctaagctgcctttgagaaaggctagtctcaacccaccaaccacctcacaatgaaaaatctgagatgctctgaggaagagagaaagactgcttttccctctctcccctccgttaccttccaatatttcttctcctgacttttgttcctccttttgcatcccatagtaaagggtgtggggtgctggtgaagagaagatgcaaagttgtgtttgtgtgggttggaagggaagtggttgttagcaggtgtcctttaagaaaatcagacttcctggcagtcacaagggaacaggttgcccaaagaactttgagtgcatcttgtctgggttgtaacttcaaatctcttttattttactgtcagtcaatggcttctgttactcttgctcaaagagaaaggtgtgtggaggcttcaagctggggggtgattctctgtgtcctcagcattgacccatattaaaaacccaagaacactaacataaagacactgtgtgttcacatgtgtgcacatggagtgggcacttcatggagagacactgtacaaacatcatcagggtttatccaacaccctctgagtatggagaagtttaaaccagcctagatatactgcatgacctgcagaaagcaacaggtaagctaaaatagggcctcttaagctttttcactaacgacagtctgcccaacacctttttgtacaaccccaaatgcataggtatataatacaggtaagcaaaccaaatgtttactgcataataatcattcatcaatacagttattttaaatattttgatatgcgcaataattttattatttatgaaggcaaaatttcataaataaaaatttctagtaaggtgaggacacttattcttgcataaaagtgtaaatctcgactgagtatttgatactgcaggacacaggaccaatgattttcggggttgattgatactttgactttataatcatcaatgctatgaataatgctgtacataaatacatagtacagagtggtagaaatgcatccgggaccatttcaaaagttgttctgtcctaattccatgtcaaaattcatctgggcgttttaaaacctcatattgcaacacaattaaatctgaagatttgcaccccaggtgctcacacgcaccctgaggagcagaggaaagcattcatgactttctgtaacttaaccgctatgttcccttaagagcagagcactcgcctgctaggaaggacactgacggaaattcctaatgtcatacctcagacctaagttgcttcaggctagccttactgtcatggatggcaagacagatgcgtggtgaagcatcttatgagcttagaaccaaggctgcagtatagtcacatgatataatgtgctaagcatgattagactccttgggttcattaccttataggcagaacaatagtctgactgtatactaactatgtactatatactgctgccaacttgttcacaacctccagattcagtttgcaatgcaggactgatccacagtttaagcatccctacttcagatacaatctgtgctacctcattctataagcaaaaactatgtcttactacctgattttatttctccaagtcaggtaaacttgattaaattcccagtgggtggatccctaactcatagataagaagacctgtttatacagcaaatttgagaagcctaacagtttccacattacagtttttctacttccacttagaagttacacaaggagtcaggacacacagcagtaatgctacttaggaaatcccattcttcttggacacagattgttagtacacagggctttcagattcaccttggggtggggctgaggatggagggatgtgcaactgttcgctggtggtctccagtagagctgatggccagcaggagctaaagcctcagtaatacaaagttgcaaagtaaatgaactggaagatgcagggcttactttctcatgcttctgtctggatttggctaaggattggctgagccagggtcattccctgagtagactatattttcttttctaccctgtagacttcagatgctcaccttggaggctggtgacatggcacagtgggtaaagatgcctactgccaggtctgattaactgcttgattccccagaacctacatagtggacagaaagaaccaactcttacaaactgtcctttattctccacatacaaaccttagtaagcacacccccacacatacatacacacatgcaccatatgttcacacacacacacacaaaacatcccttgtttgtgagacagagtagttcttgccgtcaattgaagtacagacagctccaactcttgttaggatcagcaggagtttccagcatcctagacatccatttctgggtttgtggagcatgcaaaggtattccttccagtttgtgattcttgaggataaaagttgctggctttcctttggacaaccacaccagagcatcttgctaggacattggtctcattcctgtgagcttgattgacagggtggtgggaataacatctgccccactctgcagctttagaaagttctgctttgattggaaatggtcagattggtcattccgcgcatatcctgataccaaggttcctttgcaggtcttcaacacacattctaagtttccccagttaaaaaaattatgccgctctctgtaaagcacaaaactcgtgacactgtataatccaaatgataggctggaaactgggtttgttgtaagtaacctatgaacagcacctggtgtaatccctgttaacacgctcagtgcctagagcgaaactggcaagcacagcttcaactcttgccagtcacttgtcaaaccccaacctagggttccttccaaactctcagaagaaggtccaagacacaaaacctcatgcagtcctcagactctaccagggcaagggctggatctcagccaatgtaaaacataacctccgaattagaaaaggaattctgtagcgttgggcaggggcctcgggtgtcaagatgctgattacgaatgtgaagggttgtcgtgtcatgcttaggagtcagagtgaggataaaggtgaaacttccttccttcagcaggtctgctcccgagaagcatgctagagatatagaaaatgcttccccatccatgacaaacaaagaggcaccatcttctccagcctaggattcagcaatccgaatgccagagatcagagaggcaggcaggccgtgcaaagcaattttgcagatctttctagagggtgcgtaattgagtctcatgcaggcagaatactggggagggatagttacaacacagtcaagatgttactaggcactgtggtgctgcaggcactgtcagatgctttttctagacattctgacaactttatgagattggtaccaccattttcccatttcatagacaaagacagattccatggttacaggagacagtctgaaatgactcacggtctggtctggtataacttttaggactctgggattactaagtcttggctttgccacttatgtgacctggaggaaagctcttaatatcttttcatccctattttcttatctgtagaataaggaaaataccattatagacatcatgaagctgtaatgcagatgaagtaaatgggtatatatgcagcccttggcactgggcccacatagcgtaagggctatttatattctgtggtacttatttgttctcagtcaagtaagagttttgaacctagtttagcctaatggtgggtctgagttccttgttaatacgactccctcgaagcagttgggttaaatttgttcctgttctttgattacatgtaagaggaaatcagaagcctgctttagcagtatcaggagagctcaggtgtcctggaaatacttttgatccacagagcatcttttcaatgaaggatacttgctattcaggccagtagtgagaattcacatgaaaatgagactgtgtgagctgaagggtaaacaactgcatttttgctaagactagtcacacatttagaggcatttggcagccagaagtaagtctagtcctttatcaacacacagacagagggttgttgagccttttgctaaatctggctctgagacacttctgtctttaggtccaggcagttgcttcattgtgcacccatgctgtcctgatattttggtactgagcacactgctgtacattcacaggacaccagctgcacgtgtgtatcatcctctagacaggggtcatgtgccatataaagttatcatataaaccgacggatggcatgcactttagagaaacaaacaccagacaggtgggcagacaagattctgcctttctgatgagattgaacttccccctacagtcttagcattacatgactggaatggtcagtttagcacgatttcatcacatcttccaactggagatttaaaatttatgattgctataattgtagataagatgtctctagataaagaaaagcagcatagactgaaaccaaagagcagcagtaagtcccagccccctcttgccttgagagacctccatgaaaaaactacctatattaatagaaagaaatgctaatggaatattttttaaaaattacatatacagtttccagtttgtcttttggaaattacacctagctgttcatgtatcaggtcttctcatgaacacatttaacgtacaggctttgcacatatgtgtccatagagactaggaatgaagctctcatagttatttgaagggccaaggtcttgccactccctgtgtatagtcaagccaccatgcataacaagagagcttctaagatattaacacgtcccaaatttagcatttatgttcttgaaagcacttcctttccccataaagatctaactgaacattagaagttttgaccttttagttttttttaaagaagtgtttgatggtctgattgttttcaacaaaagaggtctgttctcttgctgtagggagagattcctcagttcttttgagagagatgaaaaccctctcttaagcctgccagagtggagatcaagggcatcccagcctgtctctgaaggatgattcctgtccatgaaaggaaactgggtggtagtgggcatgttgaaaaccaatgggcttggctctagaacttggcattttattcatggctgtctacagggtggctgtcatgccttgtgactttttgaatatatgttccctgtgaagatctgctggcttttccaaggccagtgtggctctcctatgggatttgatatcataggatccattttcctatgaggtctgtttcttcaccccaactaacttgctgagcctgtctggctctttactggcagcactacccaaagctttctgtagaaggttgcgttgcacatccaggggccaagtcggggcttcccaaggaagagaggcccactccgctccagccctggtctcagatccttaggtgctgcttaatcatcagctttccagatctcagaaccgctgcatcttcttagcaagtaggtcaagtgagggcagggacaggaagtcaggggctgcagctagggggaagggtggggccctgcgccatgtttgaatggagatagttttctgcctatccctgctccttttgtctctaggcacagatggcttcattctgtacatctttcccccatttcttcctctttcctatccttccctttcttctctctccctttccgttaaattcatagtggtattcaggcccagcgccattttataatgaggtttaaaaaatggggcacagagagtataacaaaaactgtcaaaatttaaagtgaacaaaccctcaatttccttctaaaagataaactacatcatgcctgaactttggaaaggtaattatttcacaataatacacaatgttgtaggagaaaggaaagaaggaagagaaggagggagggagggagggagggaggaaggaaggaaggaaggaaggaaggaaggaaggaaggaaggaaggaaggaaggaaggcaggcaggaagggaaagcttacagtaaacatccataatgcctacctattgtgtataattactgggctacagttttctcatcaactaacttcagctctatattagtaatcaattgaagttttgaaaacatgaagagctatatataagccattatgtacagctgtcaatctgtagcatcccttcattcaatcattcttttctgaataataaggattgaagaatgattactaaatctaatcactaataaattacatagatgtggtacacaggcatctcaagtaacacaaacctgcttctacaccacccttacatctttacagaacatgtgtgattcactttagttgatgcttttaaatgattatggctttctatactcctagcacttcccacaggcaagttgtataggtaatttagatatggttattttagaggcttttcgtaatttttgactatttggtaaccattagaccatcttccttgtgaatgaatacatacattctatagagagtagagagtgtgccctagagattcagaactagtgtgttcctttcatcccattactcagaataccaccttatatggcttggggaatatacaaaattagatacactgactactaatgttccaagtctgcctttctcacaaacactactgtgtgttgggcacagagagaagagagatcagcaaatttcagtcaaaacttggttcatttgactgaaagctatttgtttgtttgcttgcttgtttgttttaaggctatccatctcagatcctcctgatagccctatgaactaataatttgtccaaactcctcctgtaaatgattcttaattccatcaccatttgtagctccctctctgtccaatgaaccagaagttagcctgtaaggcatctcttctttaatctatattatggtttttatctttatatgcaaattgatctatttcctcaaattagtgtatggtcttaagaaccatgttattatttcacttttctggtgtcttgtgaggacaatgaaaacaccaaaggatgtcacaaatgggagacagctatggggacaccagaaccagtgcctttaaaaataaacaacagtgtgcatgtcaaataaaatcttacaagattttcaacataccaactccataacagtaaggttactcttttagaaatgggaccacatgggagggaggatgagttccaggtccctcacctccagaaggccctggtttcagtggcctctgatttctactggatgagagaggcatttggagataagatcagtggctcggcattttgatgaggagggaagcatccattttcatggctttgacactttggtctcaccagagattagacaccactaaggttccttaatcccatgaatggggactgtctggagtttgcatggcccagtaccttagctgctgacttttttgttcaagactctttagcagcaatttccagtttccactcacacctctggtgagaccaaagtgtcaaagccatgaaaatggatccttccgtcctcgtcaaaatgctggatggctgctggctcttctcttgccattgtcactggtcctagtgtaagggtcactcggggaggccagttctttactactttctgtggttttcttcacatgaagcaaattttaaaaaggctgagagtagaaggctggctgcccagcagcgggcaacaaatcctctctcttgaagacagatccggaaggacactgcacgtccactgtgtgtggctccttggagtcctggtgcccacaggagagtggagagcgctggtggcatctgatggtccagtccttacttctagagataggaagtggagattcctagttccaagcttctgagatgttccttgctcagtgttttgataagtagaacaatgtgcttccagagaaattctgtcagtagcgtccatgtccttctgtttcaccaggctaagcagccatttttatatttaaggtctacatttggttcagtagacaatgtggcacactgaaggaggaaaactgggctccagatcccattgccgactataggaccatgaacaaaaatgctgactctcctggatcatagcccgtcagtggtcctggttccagttgataccaacaggaatagtttataaactataaaagagtgtttaaagtctctttcccttcactactccatagagttatttgctcggttattatattaatgtgttttctaactttcaacgtgtgagtctttccatctctttaaacagagcaaatgggagatcttgttttctgctaattatttcagccttctccagagactcatttcaagtctccttccacatcaagccattaggccattgctttggacccatccaccagccatcaaaaagcatcttgtcagggctgacatcctgccaagtgcacctcattctgacagtttctttggtttaaaaaaaattttttttattattttggtttttcgagacagggtttctctgtatagccttggctgtcctgaaactcactctgtagaccagctggcctcaaactcagaaatccgcctgcctctgcctcccaagtgctgggattaaaggtgtgcgccaccacatccggcagtttctttggttttgttctttttcttttttcctgtttttttaaattttttaattttattaaccatctgcatagatgaactctttgcaacttttactttttattttctgctaagtcacacctctcccaaacttcagacattaggattcacttaaaatgttttctttactgtgaaaagaatcaagcatgcagaataatacatgaatattgacagattcccagttccaagacacataacaaagccaacacctatgcaccaactgcttgaccaatatcaacataagagacgatcttatgtttcacttttcaagtaaatatccagggtctacttgtatccagaacttgtgatatatattgacgaccgtcagatcatctggcctacagaaatagttcacgtcattaactaggcatgaaatctaccaaccagtaactgcagggcaaaaagtcgtttgcagtgagaaatacaaacaggaagagagtaacagttagttacctctgggagagttggaatggtttccagaggatgtgacttaaacagttaagggtgatttgcttgggaaacaagagcattccaggcaatgtgttagtcttccattactgtaacaaatgccccaaatcaattaacttaaaaagaggaatttgcttgagttggcccctggctgtggaggtggtaggctgtgaccaggtggatccatggcattagaatacatcacagtgggagaatgggatggaggaggcctctttgcctcatggcccagagagaaaggagtaagagtagagcacagagtcttcagctctgcttgagggtacacctcagtgattaaagcctccaccagatcctacctacctgaagcatctaccacctcccagcgaaaccaagctgagaagcaagccccgaatggctgggcctttgaggacactccatccatactacagcacaggaggaacacatgccctctgagtgtctgtgtgtcccatcacgatagctcttgggccaccccatgatgtccttcatggctcttgaccattccttctcaggtttggggcctgcacctttctaaatgcccacattcccgtaggagtgccattagacgtctaccctcaccatgaactgattcattcacccatttactgaacaccgagaagagcctgccggctctagcctacctgcagatcactgacggagcttgttaaaggctcaagtccagtctctggaagctattcaaaatttggagaagaaggtccaggcattcagagttctaacacattgccactagtggttcctaaggcagtactgtgaggacccatggaaacacaaggaaggaatgtcttgtaatggaagagagagtggtaaagacccctagagaaccaacctgctggttctccttacctggatcaccaagacacttcctcctggtcccacccctgccagtccctctggtctcacccaccctccagtctgaaacactcacttgtgtgtgcacatacctcccctccccctacaccatgtctccaagtacctgctcagggccagtctttcctgcaggtctactcagtgccttgccgatgggtggaacatcctgagtagccatagtcactcagtgaagaacagcaggtaaagttaagtatttcaatgtgacctttgcttggcttctgcactctttctgtcaactacttcagggggagaacgcagcagggaaaagcagagttgaagacaaagtctaaggcaggaggctgctcttctctgcatgcatttccattaccagcagcacctgaacaatttttaagacaggttaactgtgagcctggtcacctctactcactaatgaaatctgtgcctgtagctctttctcccctggggacccacatctgtgtatgtctacaaatgtcctcccatagagtctcacacatatgcacagaaccttggtatggccggctctgtctgaacacacatgactcaacatgtacatgggtatgtaattaaagattttgaacacttggttttgatggtctgttttccaggggtcttgttcagaagattcctgagctactatgggctaaggaagagttgcagcaagtgtttttcggctgctctttctgtaaagtgccctctcttctctctctctctctctctctctctctctctctctctctctctctctctctctctctctctctccctccctccctccctctctccctccctctctccctccctccctccctccctccctcccttcctctctttccctcctctcctctctctctctctctctctctctctctctctctctctctctctctgcccctccctgcctgcctgcctgcctgcctgcctctgcccctccctcgctggctctctgagatagcagcagaccgagaggctggtgcagcgtgctctggggaaagagtgagcttgcttgcagagactggcagcatttcaggcagctcctcttgcatcccatccatgcggtgttcttggagggcaatgcaatgttggagcagggattgacctgcaccgggagggtagctggttgctcagagaggccagggtcttggcttagccagaggctggaatcacaggaatgctgtagcagggtctgctgtgaaagttcccagacccccatggattttagaatttcccagcttcttctgcacctcagcacactctcacttcctcccgagatggccccagatctgcaggagacacttgagagaagctatttattagcagtcgcgaagagacggattctgcgcttggttctttagccatgatttatcagtgatgatggattggccagcggtgtgagtaatgaatgcacttgtgtatattcctctagttacatgctctgtcttatgtgctttgctttttaattctaactttctcagcgaatttccttagagaagaatgaaacctaaatgtgcaaaaagtatggctaagaagttaggtgggttcagatttctgtgtgttttcctattatgtaattggcgttctgaatacatatcagccctatcgcagacacacaaactattggcacagaatctgcaaacgtgctccagaggatgagaataaaataggaaggaagcgaatcaggattttgcactggtagtcatccctgtaaggagacttattcagagttgtgaaaatctttgacatcgacacctcttagaatcaaagatggaattgaaatgcgttctcttcgcagggtcatgaaaatgaagttagcctatggctttcagagcagattctttctagctacatagatgcaagattgataaaaagaaagcctaaggttcaatgctgactgaatctccatgggcttcagctttgcctgagacggacccctccctgttctagcggacggggtctgggctgagggtactggtgaggtaagagtcagccgtgtgagagctcgtccatctttctgtatgtgctagaatttgattcaagtacctcagttaccaagaaacatgaaaacccaaatcagtttactgtcgcagaaacaaaaagatctaaaagttaaagataggatttgcatttttctcacatatgaagcaaggtcaattctgtgtaggaagagccacttaagctttctagattaacacatagtcttttattagagatctttaccatcataaatcacttgagcatggatgctttcagtagaggatttttttttttggttttgcttttttgttttacagacagttgtaactgtcccctttaaagtccctttggtagcagtaactatttctgcccacttgaagctgcgtggatctggaagaggcttttctaagaaggctgttatgacttctctgcctttttggatacaaccccaggcagagctactcccctccacctgcctgccctccctgattgtctcctaccccacactttcctccgaatcttggaccatcatgaaatccccttctctagatgctctgggaacatacccagcccggtcctggacagagagtactgtaaaaaaagcaacccgcagctctgtcaatcaaggcctgaatgagctcagttgattcctgaatattaaatcagttctgtgagcagcagaatgagatcagacctgacccaaagtggtgctaactttattaatcggcacataacgttatcatgagtctccaagctcctgaggggatcagccgaaagccaaactgaatccctggactagtctgtgattcttgccagccaaacctacctaggaccacgccttttaaaatatgtcctttgttatcaaggggaatctgagacagaaaacacatgttggcagcatcacgtgagcgccttggtgcatgaagtggttggtcgaaagaggaaaggctttgagctctgggagctgttttgtttgggtttctggtttatatgaactctggtagactcacgcatctggaagaggtttggtgggggtggggagagaacctggagcaaggcatgcagggaaagggaacatcattaaacatttaaaagaaaaaggcagagtcagacttgagagatttttcttacccacactcgagtcactacgcttttttgggtccccataaaggtaggtatcaattgcaaccttcctgatgagtggggagggattatttcttaacacttttggatttgggggggggaagaatttgctttctccagaagtagaaaggacagtaaggagcaacaacctttcacatgcctgctcatcttaaaaagagcatgcatccctgtctacatttcctccctggtccatgtctcttggtacctcagaagtgttccttgtgggggaaaaaaagagagaaaggcctcgagtccccctggaccctctctgtcctattaagggagaaggatgagcagccaaggacagggttttagtggagggtagagggtagctttaatggtgaatgaggaaaaaggccaggtatgctgatatctgcaagcagtctttgagaggccagtgattggcatcaggaaaactgctgagcaattaaaaaaaaaaaagaattaaggtgagggagaaagagaaagaggaagaggctaggcgttcctgaggatcctcaaggatagtatagttttatgaagagctgagaaggtctacactggtcatactagaaggttagaaatcttacacttaccagaacctcacaggtgggacaaagctcacatcggggtccaaagttctgccaggaaagcttgcttaagatgcactgttggctctctccatttgctgtgtgagtacttttgtctgtcctggcattctcctaggtaacagcttccattccgtgaagaagggttctcaggaagcatggcctgagagtctcatctctgaagatcagggtggccatggagaccttgtttctcttatggcacacatatgatctgcgttctaattcttgttctgtctcagctgatcctccttatttttgcagcccctagtacttttcttcctcataagatctgtttctcttccataccaccagccctgcagaaaaccccaagtccctggtaggtctggctgcagagcccatccaggcagagagtacatctatttttaacctcactttcttacctagtccctcagagagacttcaggtaggaaacacatctttgatagatttggagaataattacatttaatagcaacatactgtattccttaaaattccttaaaagtgctaagagtggatttgaagtgtgatccccaatagatatgtgagatgatgcacgtcgatcagctcagttgcaatattcctcactgggagcacatctttgttgtacacaacaaatttatattctatacttgtatacgttaccttaaaatttcatattgttagacttgtaagaagagaaaatttgactcatgggaaatggacggagaagttttcctgatcagaggaaaatgttactttttccctcctagacctgcccaaccttttgacattgaaacacaacattgtcatctaaaagtatcttcttcaggaaatgtgcgataaagttaacaaaataaaatacaaacacatgatggtttaagcaggctcatgattttgcattcgaaactctccagggccacatgcaaccacaggacacaggctgggcattcccactgtcactcagtggaagagctgctgctaggtaactgctaagttgtataaattctgcttattacctccacttgagctcctaatctgtaaattgcttagcatctctaagctcataattccagttccaaggaatcccatgcccttttctgacttctgcaagtaccaggaatgtactctgttcacagccatacatgtgggtaaagcactcatagatacacataaaattagtgtaaaacaaaaacaaaagcaaaaacaacattttaaaagagacaaagaaagcaaaaggtccagggtaccaaaaatgttccttacctacttccccaaatcttcatcatggaagagtctagtcaatagaggagcaaagatttttgagtttgacaagcacaactctggatccctgctttgttgagtctttgctgcagtcaggagctccctcgcctctgcctgtgtttgtttctgtgtaggactgtccaccactaaggagagtgagacctgattgtccacgctctttcagcctagccttggggaccaaagcaggagccacccgttctccacagactgggcttgtggtttcccacaacaccgtgtgagctcaggtttctgttgaaatggacttcttccttactgtaaaagtccattgtcctgcagaaaattttctttcaggaaaaaaacaaaaccaaaaacatgtttggcaggaaagggtggttcctgggggcagtcctgatataaagccacaagatggtccagggagccctgtgcagtgtacacgtgtgtgctttgtttatggaccactcggtagggatgcggatgctcatatctgtctacaggcaactgcctttgccagcggggcaaggattctatggatcaggttcaagacagcaggctgtgaaacttggttttcatgttcttttgaccctggatatctccacaaatgagccacctgccatatctgggtgctgggtggatgtgtgtagtgaagccacaagtctgcaaggcctttctctgcttaagggacagggaggaatcccacaaatccacaaatccaagatgtcagctcataaatatgtaaggtctctgtttaggtaataagctcgatagcccaggctgtcatttgcacatcctcttcagctgaacacaaaagttccctgccagatactgagaaaggaagctggaggatgggggctgggaggcgggccaggctgatggctcgggctattctggctactctccacactgctgtcttcaccctactgggtgttttgtgtgggttctctctctctctctctctctctctctctctctctctctctctctctctctctctctctctgtattggtttactgtgtgcccaaaattaaccatgtgacacttggggtgaatctgggtagtaaggaaaaattgtagccaacttttttttagcttttggctaaatctatagaaatttccatttctgtggcatcattactaaaactctcaggatcttaatatagatccagtcaatcatttgatattaaaatctaggcctatggatcaaatgcaagctgggaagcagacctcagtgtaaggacactaactgggcatctagtggtactttaagcattttgtaagggtcctgggattggaaagtgagcccaggaaaacagtgactgagacaggagctgactctgccacggcagtcagccaccaaaaactccttacaagggaggtgtatttctagcagaacactctcagacacacagaagtagagaatgaattgtctttgaatagagagtctagaataatgaggcagggaggaatctgggaaggaatgcctttctcaagtgaaattaccatgagtttctgtttacccacactggcctgagagtgtctggcactgtatgaccttaggcatatctcgtgatgattagaactaaatattgtgcagattctcaggttaggcagtgtttagtgacagatcacattaaacagagcatcataataatggcaaagagcaattgtgccacagcagctctctgccactgtgacaaaaactctggtagaaataaacttaaaaggacgagagccgaactgtgattcatggagtttttcagagtttcaattcatgtcactttgggcctgtgacgaaacacaacatcgtcacagggagaacaaaacggacacttgcttcacggtggccacaaagcaaagagaaggaaaggaggacgagattctgatctccccttcagagcacacccctgtgctcccacttcttctgctaggtccctccttcttaaggctgcatcgccttacccaagcctttcacacacagcctttgggaaacatggaagacctgagttatcacatatcaagaacaaaactcaaaatcacaccatatccttacagctgattggaaacagtagatcgtgagtccataaagagggaacataagaagagactcagccccgtggttatatcatatgtttttatgattgacaggggatgatcatttttaattataagataattgaccatactagtatatctaaagataggatagccatttctaaaaatcctttcttcggaaaagggggatggaggagaaagctgtgtatgagagagaacaggaaaatgagtgtagttgacctgggttcactggaaaaggcctgaagttgtatccagggaaactgtagataaagcccaggactgcacagcactctgtggatcatcctgtcttctcatggttgttgtcagcatgctctctgcacttgaaaaacccacaataggggggagagatcctaatgagccttctaaagcacctcaagtgtgggataatgatttggatacttctcatagcaagctgagcatcacagtggctgcagaggagtatcgtcttaaccctaagagtgtccttacagctcacgtgttctctaaagagcaggattctagggaactaaagtaaaagagcacactcctaaacattcttggatctcttcatgattctccctctccttttccctgtctgtctcccttctctctcctctctctctcctctcccttctccctctccctctctctctcctctcccctctccctttccccctcccctctcctctctccctctcctccctctccccatttctctctagctccttctctctgtgtgtaagtcttaggcatctgctcctcagatgccccttatcttgtgtttaagaaaaagtttctctggcctagagtttcctaactaagctagtctagctgtccagcaagcttccagtgatccacctgtctctgcttcccatctcattgttgcagagatggaaagtgtgtgccaccatgcttggtttcctatgtgagttctgggatttgaactcaagtacacatgcttgtgaggcaagcactttgtaggtgacatctctccaggcttggtgcaggcattctttcattcagaaagggccataaagcccttggcacccataggataaatacttgggcagccatattggctttcctttccaggagcttaaaggatgtgtgtataaatgatatttgtgatgaacaagaaaaggaagcttaaaagagcaacaggaagttgcctaacaaagtgatatgagagagagagagagagagagagagagagagagagagagagagagagagagaggttttaacttacaaactatagaaacttatttccaagtgaagttggcaatggtggcttgtgctggagagctttctggattattgtagaacatctatctatactggttttatttttagaagttttaagcatctagtagagtagaaaatggtaaaaatatgtatttggcttatttctcaggaaatgcagaataggattcgaattgaattattgtcattattccacagtctaatgagaacatgcccaagagcatgactgtcaagggtttagtaggcagagtgctgcatgcctatgatcccagcatagtcctgcaggcccataatctcatcatagtaacacatgatcctagcatagtgctgcacacctgtggtcccataactgaggagatagaggctgggggagggagtgtcttgggtgaggctgtacatagtaaactctgtctcaagaacatgtacagaaagaatatataattttgaggaaaaagactatgctttcataaaataaactacagactagttatgggtggcttctcagggcatccctctgctctgaaaactaccccaggaagaagccagagacatgaacttgatgtcctctggagaaaagagagaacgccctctcctgctagactggcagcaagtggtttccttgctaaaggtcagaaatggaaaaaacaatcatctaatcaaattgacttttagaattaactttgcaaagcacaattcacagggagcccagaggcatatttgtgtcaacagataacttaagaagaaaatctcactcccaaaggcctggcaaaacacatgttggacacagattaataatgatgcagaaaattaattataatgaacacaattattacattcattctgtgaatgtgatagcctagaaaataacatattaccatcatcacctggaagccagcaaacattaagaacaaatgaaagacccattcatttatttattctttaagtatttgtttaatatctactaggtaccaggcatcattccattaaagaatattttcattgaacctttaagaatttcatacattgtattttgattcattgtattccactcagatacaccatctctttcctccccctccgcccaattttctcttcacgtcttctttggcttttaataacctgtcaactcaaatttaagttgtccatatatacttttatatacacagtacactgtggattacctaccaggagccatacccttaaagaatatggacttcccctcccccagaaaccatcagttgcccatcaatcttcagttatgggtgggggctcgtgaaccccttctccctctattctattgactggtttgaacttgtgcaggcaaccacagctgctgtgaattcacaagtacagctgtcctgtaatgtccaggagacatgtttctaatcctaccctcatcaatctctgactcttgccatcttcctacttccttctttatggttcccaagctttggggagagattagtacatagatgtccagtctgtggctgagcactctattccctaccctttgatgagttgagttctccgatgaccatcatcagctcacaaatacacttctctgttgagatctgagagtggtactactctatgagtaaagagaaatgaatttagagtacagtttgatgctatgtccacttagcagaataactgtccatgattgtaggcaccatgaagtccttacccatcagtgcccattggttcccactgtaactgtccacactcagcaccagcgctggctacctgcttcttcctttggagcaccacaaccatgggggaacatgtggatagtgagacagaaaaacaaagatcctgggcaatcagagaagcctctggtttagagggccacactaaacaacaacaacagcccagaatcatatccccttatgtacagtgaagttcctgttaaggtaccctgccaagcttgttataaattatggacaaatgcatctgaaagcatccctgcagggcctctgcaccggagaaatccttagttaaaaatcactccagatagaccagtgattctaaactcattatggaggaggagaatatggggactctaaggctgatcctgtcaagaagtgcagccagatttatattttctgtaataccaatgatgtaaactaaccctgtctatcctcccaactgttcatgtactcaacaatacactcatgcatgtatccattcatccattcacatatgtgtggtttgcatcctgttggggaatacacctttagaaatgagagctggcttgtgaccttaaagagctttcagtcctgtgaggatgatacaagtacctgcagccaattgtaagaggtggtgtgtgtatccctcctatgtcctctttctctttgtgaccatgagaggtatggtgggaagactttatcagccttcatgaccagtgtggaaaacttatcttcagtggaccatggaaagtggtgctggctcaaattcagtggggaccagctgtgtcagtttcattagtacaaggttttggtcttgtgtgtgcattgattttgcataattctctctacgtgcccccaagacacagactatttgaagttgtagtagacaattagttttcttttccctggacagtcttgtctgaggatgcgttgtcagagaagaagccagagtcagtgatcacccctggtgagtcaagggtagggacacatcactgacctcttgatctggtttttggagtgaaattaaggatgtgagcagaaatcttcatggcatctagttcaagctggagatggctgcagtttaccagttaaaaaaccaaaggacaaaaaacaacacccccccacacacacacacacaaaaacaaacaaacaaacaaccctctctttttttgataattccagccatcggggcaaccaaaactcagattggcatagatcattgccacggtccatttgattgctggtaaacataaactaaggactgacagagacaaagggattgtgctaattttatgtcagcttagcacaggctagagtcatcagagaagaggaacccctaatcaagaaaatgtccccataagattgggctgtaggcaagcccggagggcattttcttaattagtgattgatgtgggagggtccaccccactgtgggtaaggccatccctgggctggtggccctgcactctataagaaagcaggctgagcaggccttaaggagcaagccagtaagcagcacccctccattccctctgcatcagcacctgactgcaacgctgcttaagctcctttcctgtgtaagccaaacaaaccctttcctcccaactcatgttgctcatggcgtttcatcacagcaatggaaagcctcagacagggatccaaggcgcctatttcagctctctgattacaactcatgtacttagaagcttctgtgggagactctcctaaaacacacttaggatatagtactcatactgacattttattagcacaatagcaatgacaaatgtttgctgggtgtctctcagtgccaggacctgtccagggattatacacatgtgctaacatctgccatctttacatcagagcaagaatgttttacttttttcttgacagtctgttcctagatgctttatcagagcatcaatatgattttcctcacagtaatatcaggcctgatgatttattcttagccaggcactcaatgtcaaaagattataggaataattaacatggtgctaaagttgaaatactactttaaaatcgatatggtcacttaaaagagcataattatggttgggggatggctcagttggtaaagtgcctgccctgaaagcataaggaaatgaatttgacccccagaaccacacaaaaagccaggcaggggttgtggcattctctgtagcctgctgcggtggacagaggtagaaacagatggacccttgaagctccctggctgaccagcctagccagtcaatcctgtttccagagacaaaagtaggaagaagtttagaaaagatacccagtattgacctcaagaattcacaggcatgtgcatgcacacctgcacacacaaacatatgcacacctgaatacacaaacatatgcacagctgcacacagagacatatgcacacctgcatacacagacttatgcacacctgcacacacagacatatgcacacctgcacacacaaacatatgcacacctgcacacacaaacatatgcacacctgcacacacaaacatatgcacacctgcacacacaaacatatgcacacctgcacacacaaacatatgcacacctgcacacacaaacatatgcacacctgcacacacaaacatatgcacacctgcacacacaaacatatgcacacctgcacacacaaacatatgcacacctgcacacacaaacatatgcacacctgcacacacaaacatatgcacacctgcacacacaaacatatgcacacctgcacacacaaacatatgcacacctgaatacacaaacatatgcacagctgcacacagagacatatgcacacctgcatacacagctatatgcacacctgcacacacaaacatatgcacaccatgcacacacaaataaaaacaaaatagcatcgttatgctccagattctgcagaatacaagggaactacttacattaggagtctaataactaactaatatctatttaacttaggagtctccatagaaaaatcattattctgaattttgtactttgcacctatgtctactaagatttaaaactagttcagtgtgcaatttattgtgttctgggtccatttatagaattcactatgtaattttaaataaatcttccttttgttttgatcgatttctctctttctcactatttgtttccagatggttttctttccgtacagcttcagttaatcgtttgataatcctttccaaaaatgcttactaagtaactattttatatgacaaagaagtaataagaaataacatgaaaagttagttgagaccaatgaaataaacaagaggactctactgtttttgccttatttttaaattcttcctttcttgccccgccctcgtcatcattgtctatcccccattgcacatgcacaggcttgtactggagcacgggggtgggggtagggatggggaacaacatgagcggctgcaacagagaaatttaagtgggaaagatgcttagtatttagtgatcagtctactgcctatcaatggaaatgggtgcccagacttcctccctctctcctcggctacttcatcacctaactgccccgcccaacccccatagagaccatcaaataagcaagtatgtgtggcaaaaagcaaagcacaggtctttgtagcagctttgaagcaagcttgcagaaagcatttccctggtagcctgtatggtccgtgatgactacagaatcttttccttcacagcctgttttgttctatagtaatctcacctgtaccgcccactccgtggagacggcttgtgccctttagtaaaaccagagagagctgcttccttgtcactactctgcagcattgagcaacctctttttacagtatctagactgagcaaggcagtctggtagcttgcccactgctatgaacagagtacacaagagaacactttaaaggacaaacgtttcattcggactcatggtttcagagggttgagcctacagtcacgtggctctgtgcttctgcggctagaatgaagcagaagaactctgtggcactgtgtgtgtgtgtgtgtgtgtgtgtgtgtgtgtgtgtgtgtattgtattgtattgtatacagaagaggggaatcagagacaagataccctcaaagactaaccaccagaaacctacttcctctacctaggtcacaactcctagtgtttttagaacctactaagataacaccaccagctgaaggccaagcccctgacggattagtcttttgggagcatattttataacccagccataacaagggtgatgtaaatttcaacctcttacacttccgcagggttgccgaagtaccagcagtccataaccacagccaggaatctagggcagtcctaccttgcagcggagaccagacagagagtgacccacttcttgctcagttccatacagttgctgtgcagagcccccattcagatggttttcattcggaatgccttagttaatgatttcttcagatttcacctgtggtaaataattttgaaaataaaaatatggcagggaagaaaatcacttcttctatcaagtgaaacttatattcaaatttaattaaccaagaaaccctcaaagcagatagcatgtcacatagcattgacaattaattagttttgctctggaaaaaaaaaaaactgtaggcatgagcaaagagttatagattaggctttgtttcctctgccaacactgcccatttctagttctcacaccttgacagcagtttgcagcttcaggcaacacattgtatctgaagtgtgtaactccgtgtcagttttaaatttcacataagcaaaatacagaggaatgagcataacacgctattacttttataatgaagactttagaagtgagcagcaagaccagtttccaagacagtcttgtgccaaatagagaaggaagataaatcttaaggaaaactcagaggaaggaatggctgcccactggctttgagatggacagcctgtttctggtagaccatgggacctcttccttttaactttacattagcacatggataagtgacttagcccaatgtaatgaagagatcattacattcattggagccttgaaatcagattagctggaatatgcttattccttgaagggattttaattttggttgggcagtcctcatgctgtgatagacatacatccatcttttatgcacaattgcatctcagcagaaaaattgagcacttcattctctaaggagcagctgtaactcacctatggttatctttttctgcctgtaatttatagacactctaaacaacagtcttatagatgcatggtgtcttagtcagtgttctgttgctgtgaagagacaccatgaccatggcaactcttataaaagaaagcctttaattggggctggcttacagcttcagaagtcaagtctgttatcctcatggctggggagcatggtagcacacagacagatgtgttagctgagagttttacatctgggtcctcaagaagcagcaagagagagacactgggcctagcttgagcttttgaaaccccaaggctcactcccccatgacacacttcctccaagaaggacgcacccatttcaacaaggccacatctcctaatccctctcaagtagtgccactctctaatggcctagcattcaaataaatgagcctttggggttggagtacattcctattccaaacattacacatgctttcattaattgcattcaatagaaccagccaattttctattactcattcttagagaggacagccatcatgtttattaacaaaaaccatttctatctggcattgggtggaatatgtaacttgcatttccagttaacttaggtctgttgtttatggttctcatttgcttcttgagcctagtttgcacaggcctgacacgggaatgggtaagaggatatctggtttccttggtactgagcatgtttgggtctgggcagatagaaaggtctttagacatgggcttctgggaagaagggtttgtattcgtttcagtgccttttgccctgataaaatattctgacggtagctatttaagtatcagtcccagacgtgacaaccattacttttgggaccagggattgtatcaggttaactgctaacacttcagttttttataactcataaatttcaatacaaataccttccctgcttgactcatggcgccgggtcaggatggatgtggtggcataaggatgatgctttagaaaaccataaaacctctcagactttaagaactgctgagaactccagactacttaacagggagacttttgtgtgttgctgcaactgccaaggttggatggattaagaagagtgtgggggctggagaggtggctcagtggttaggaacactcactgctcttcctgagaactgtagggcctttcccagtaccgatgttggatgggttgccatcacctgaaacttcaacttcatgggtttcaactccatcttcttcaccctgtaggtatctctactcccatgtgagcacaaacatgtgtgagtgtgccccctcccgacacacacacacacacacacacacacacacacacacacagagagagagagagagagagagagagagagagagagagagagagagaatattaagaagtccagtgtgtctctatgctatcccttcagcaagatgcaaagctatccatcaggcagatctggggaccatagaagaacaaccctcagtgaatctacagggcagggagggagaagacacagacctcaaaccatgatcattcttttaaacacccattgctttatgatgtcactagaaataaggacacagaaggctgaagagacgggtggggatgatttgtaagagaaggataaatgcccagccattcttacctaaggctaacgtccagtattcctgcacaaaactcaatccattttcaagttatgacacatttcctgtaatgttttaatgtgatattgttgagggtaatggccagccgtgctttgcctcctagcagtgaatgtttatctgaagtcatgtcacgaattatctttctgcactaatgacatggatcatttgcataaaaatcaggatgactccaaagcccatatgttttgtttttcagtctttggagccatagaactgtccttcctgatagccagttaggaaataggaaggcaatggatgtgggagggcactcttcctgattgtgggaattccaaaacgccgatggtatatttcacagcccagccagaaggcttagaaacaggtgctatttcaagatgaggcacggctggtgtttgttacacgtggatgggtatcttaactctctccagagggtctgccttgaaccacaagctcttgccacctcccctgcctatttataatctgttttattatctccgctccctgtgtcattgaccctgtggattttctggtaactcctgtgatctgtcatgtcatcgctcattattagagagtcttaatcctctgagcattgaaatatttccgtgatggcacagaagccctgatggcaccagccgctttcacactaaattgcagcttgggttgtccttcacgtgctgatggaggcgatttgactgtcatggtcccactcctaggtcaggaccctgtcagggcagcaggtgtggccgtgtgatggccttgtcatttttcagatgatccctgccatgtgttgtcccattggattgaatagaccttgaatgatctctaaatttgtgtaaacacttcccccaccttttctgagcttcccacctgtgaacacccctcagacaaatcctcaaggcgtgctcagcaacatgttctgggcagagtcatacaaaagttaaaggtccttaaaaaacaactctgtaaaacgagactgtgggggaggttatgggagagggatggtggggtggggggaacttctcaacaacactgtgcttgaaagatgtcataatggtatatagtatcttacttggtaaactgaagactaaaaattaattaattaaatagaaggaaagtttgtaaattaaaaaaaaaaacaataaactgtattgcctgatttttctgaccaatctttaaggaaagttctactctcgtgaagctagtaattcttcaaaaatgttaaagtctatagtatagtgatcattccacatcaaggtagataggctccgatgtagttatcttgagatacactgaagatttctatttaattgcaacacacttttgaaagtccagaatttccatctaataaacagtctatcacaaattattatgtatatataattatgtaatttgtatatattgtgcatatatttacatataatatgtaatatgtatatcatttatgtattatagatgtgtatatattatatgtatatataaatgtatgtataaacatataaatacgtacatgtacataaaatttaatttatatataatgtaatatgttataaataataaaatacaaaattgtgtataataatgtaaatagtataaatgatagaaaaaatccttcctaattttccactttatttgacagctggggcctaaaatgacctccctatttaaaccagttaaatctgccctgtgaatattgatacaaatcagcttttagctctgagtatacctggccaatgagaataggaagccatagcatgaaggtcatatcagttctaagttgatttctaaactcacctcgatgtggtgggagaataaagaggtgtcgaggaagggtggagagcccggaatgtagaaccatgcacagtgggaaccatgcgcagcgcgcctgcatcctctcctgactgggatggtgcttagcacggtgccactttctcgataggggctcagtaaatactaatttcattctgctagggagacagtctttttccttgatgtaagcactgggaagtacaggaagttaatgggtagttagaggtctgctgagacgaatggcttcaggaaatatgtcctgctgtcctcataggaacaagacaggtaaatatggccttttgggttcatttgctacttgaatttttttaaaaagcaactcacctgttttcccttatagggtgaggggggtaaggtcctgtggggcatggatctcacaaaacatgcctctagccagaaatgccaaccttttcaattcttttgtgaccacctctccttttgtgtccctgaacaataccatcatacgtgagcaatttctaaactttaaccttctcctatctgtgtgtcattgaggcactacataagaagaattggagcatataagacatgtcagagagctgctcctaatgatgtcaggaggagagtgcctttgtggagtcacagaaactcttaagcgacagcctgctcatttcaaatttctgaaattctcctaatacgagctacatacccattttaagaaaaaaaaaacaatttaaaatgtattctcaaaataatcagctctaattgaatacaattttctggagtggtcgccaacgaggctttcctaagtgtctgggagattgtaggagtctttccgtctgcgtgctgtgagacaggctgcctctctactgcatggctctcttactgatattcctttaaagtgatttttacccaccactcagacactttcagggacaaaatactctatgttttatgaaggtcatttatcaagaatgtgctttctaattttcagaagaatccccttctaattataaagccagtgtgctttatgtctcagctagtatttagctctggtagatttcgctacctaaatctagcccctactgaaaggtaatgtgaggctccttcatctagagtcaggcttagctccagcacttactatatagctcactgaagtgacactcattggtccaccaaactctttgtaacgcttttatttagtttcctaaaagagcctataaaagcagatagtatttttttttcctgaatattactgtggaaaaaccaagtcttggaaacaaagtgatgatgataatttaataacaataataaataaataataataatactgatgttccaggcactacgtgagcatgtagtcagaatgtaggcaaatgtccactgttacctacttagtatctgtactagtcacctttctgtctgtcatggcagggtgtcacggtgccaggagcctgagctggtcactctgcatctgcaggcaggaagcagaggaatgttggtgatcagcaccccagccaggaccccagccaggaccccagccaggaccccagctaatgagatgacggcatgggccttcccacctcgaccatctaaactagatactccctcatagtcgtcccagagaggtcacctaggcgactatagctctctaattctggtcagggtgactaatattaaccagcacaatgtctgaagaagctggttgttcaaattcaggctacatactgaaggccctctagagccgacttcacgtcgtgttagaagggtaatgtcttcttcgtcatgttttcctctgggattcagagtagccttgagcaaggatacctctgttgtcatttatttctctttagcatttttagaggtggttcttctgtttctaccatgctcacggctctttttgcaggaaactaagtaaacttgtttcctttataattaattaattttggaggtcccctcttcccccattcttcagttttcttatcttaggtaaccccaatttctttcagtcatttagtcacccaacaaacatttttgtgcttcttgaattttgccctattggggtttttattctataaggttaatagatagtaaacaaagtagctaagtaaaccactcgctatattactcggtcagagtcttgtctcagagtgatcagagtaacaggaattgggactttgggggtttgtggtgctttcctggggtatctacatttactggcctccatagaggaggaaatgacaagttaaataactgttccacccaaatacatcttaaggaaacaggagcatgggggagaggtgttcacaggagcatggggaggggtgctcacaggagtgtgggggaggggtgctcacaggagtgtgggggaggggtgctcacaggagtgtgggggaggggtgctcacaggagcatggtgagggtgctcacaggagtgtgggggaggggtgctcacaggagtgtggggaaggggtgctcacaggagtgtgggggaggggtgctcacaggagtgtgggggagggatgctcacaggagcatggtgaggggtgctcacaggagtgtggggaaggggtgctcatggtgaggtgtcagttgtatggctgtatggctgactgggggagctgtatcactgcatagcccactccagcatcagtgatgattccagaggctacgtccctgggatcccccatagcatttgcacactgtgtcataactcctatctgctctgtactgccttgatagccccaggcttgtgagttccctgagctttgtgagcctgtgtctttctgcaagaggacggcttcagtcttgaggaagtgagccgagccatgccacagtccctttcttaggcggtcgtgctcgcccctaactcagtggttcagagtggcagtggtcatttattagttttcatgggggtcgggaattcagacgcgatgccacaggtgaggcttctgtccactgcatgatagctgagactccagaggaaaacgccaagggaatcatgaaaaggacaatgtactcctgagcctgtcatctggagaccacgtgactctgtccacgtgatctgggcttccccacaatctttacaaaacccacattgcacttgataactcagccttgagagtcacacaacagctcttccatcatattctgtgggctacggaagttcacctttgaatttcctcttagggtccaggaggaggcacacagatctcacctctcaacagtgagtgtcagtgacagattgtaagaacttactgacagagccatctttacaaaatgccatctcctatggtgggcagggtacatgtgtggttagagaaacatttaaacccaaatttaaaggaggcaaaggaatgaggtacgtgctggtctccctgaggcagggctaggaacgtgaggtggagcgtactggacactggtatggctggcctgattttaatgttcattgccttataatcagagggagcagtgtgcagtgggcgagataggaaatgtgattctgagttggtaaaagaatcttgggtctagtttatgttagaatgggtaaaatctgaggcagattaggtgtgttatgtgagatgaattctgggtgcctgaatggtggggctgttttagtctaagatgggggagcgagtacaggagaagcctgcagaaggagataagccctttagtcttaaggatgatgtgttagggatgtttactgaatactcaagtgggattgctgaagaggcattgagagaaataaacagggagctccagggctaagctgggcaggacacttgaggagtcgcaggctgagatgtgatccctgcagctaacagcagcagctgcagacagaagcaggggctgagccctgcgaagacactggaagagaatgggatgtcccggaagcttagggggcaaggaagaaggatgtgttcttaggtctgacaggtccatgttggggctgagaccgtgacagccatcatacaattattggtaacctatctgagcagtttcagagggttggagacagatgcctaactgattgtagcttccagagaatggaaggggagggcttgggtgggaggttgacaggtggcacttgctgggagtttggatcaaatgagtgcggacagcaacagtgttgcagctagctggggaagtgtcacatgtacttgtttttttctaagagagagagaaagagccaagtacctatgtgctgtatggatggatctcaatgaaaaagctaacacacacacacgtgcaaaacatacatatacacacatgcacaccacacacacacacacacacacacacacacacagaattaaaggccagtcaggattatatagtaagactgtcacctcctcgtgctcccatcaataaaaccatttatacctttatatttacatagaaagatgtgatataatacatcaagaattaatttaaaaagtgagtctaaaaagcgaggctgcgtgaaaggcctttgtctcacaccaccatttgcgtcttcatgacttttctatggcaggattatcatgccctaagtgctacagtgtgcttggatggtggaagatgcagtatgaacagccagcattattaatgatgctgtagccacagcctcactcatgtctccatctgtatcttctgtgacatttggtaccttgaccccccccccttccttgcacttatccatagacagcattttgtatttgaaggtggtactgtacaagagcccgttatccacctgaggagagggtaatctcatgccctgcgcctcgctggagtggataatctggcctgctgtctgttcctcacaccagggtactttatatttctccagtgcactggggggcgttgtattctgccaagccactccccagtcggtcaccaccgggctcttcatcagacgggcttggtttttacaaggtgtaaaaaattttaaatgagctcatctggttcttcacagttgggcttatgccagagaaatggcggtgtggggagggggcaattagcggactaggtactgcgggtccccaaagctgactggcttcattcatgctcaggctgagtgttgtggagaacaaacaagtctttgtaacttgcgatcttggagccatgtggttttatagctcctttctcctgtcccagtgattacatagcttattaattaagttccttgtggtatagcaaagggctgcagggtactgagagtgaaggcaagagtaattaaagggccctttaagagaaagggggaaagtggccagcccagtgcatctgattataccaccttctcctccttactgtctctgtgcagagctgcccagaagttaaatctgtcatctaagaagaagaaacaccggccttcgactccatctgttgcggaggctcccctctttgcgaccagcttcagtgggatcctgcagacctctcctcccccagccccaccctgtctcctgagggctgtcaacaaggtgaaggacactcctggcatgggcaaggtaggtgctagctgctgcctctgccatttgttcagtgggtgtggctctgggaaggttgggaaagaaaagaacaaccttgggctctcattttcaaagatgaggaggtaccagggacaaaaagagacacaagaaagttggtttggaggtcccagcatgcccactttctgggattttgttcatccagggtcaacctctgactgaaaacaaccacagaaaagcctagaaataaaccacaaaggtgctcagaatgacctactgcagtacgctgctatagttagatcctgttcatgttcttctctgtgcctggtgttttaatgggactttacatggggaggtgccacagatctgtaaggtctacccatttctgctgtctgtagactgtcttggcaactagagactgtaaagtcttcttggtcttgcaagtgcattaagttggggatctgatttgatttgggtggggagggaaatagctttgcattgttgagcaggaccatagacacttcaaacttagagatgcaaaagccagaagcagaggccggaggcccagggaaaacaccacatggaagcaagatgaagatattctttcctgtggtgcttctgagtccttcttcccttcaaataaatggtgacttccgcatctgcaccagatcactggtgtgaattctgtagagtggttcagtagctttccagccaagaaatgcagtttgaagttgtcacaaggacttagaaagacgtaagggaagtctgttacaggatattactgggacacatttatgataactttatttataaatgtcaactcttaactctttctctcccaagataaaggtctgcctgaagtaatttacagcctaatcttcggtgggggaaataagttggggcttagaaaaacatgtagctggagagataagtgactctattcattactttcgtcagggtacagatacacagaacgcaagacctgacgttggccttgggtcttgtttcagaacccagctggtcatgctgaagaaagcagagccaggtgtatttttgtccttttgacatcaaaacttggtttaccccagtttatagtctccagatgaccatgttccctccagaaagaccatgcatcctgtgcctgatctccttcattctcttcttactgtttctcccctctccattctgtacccctagtaccaccatctcagagggaagcccttatgtcataatgctttccccccaaagtaaacagattttaaaatgaggtcagatagagcagtggtgagtgtcgtggacagcctccagacttaaaattttccatggtgtttctcagcagatgagtgtcagctaaaaaaaactttcaaggccagtggtaaagaaagaccttaggcagtcatctgtcagggatgctccatcttcacatggtgtagaaggcattggaggaagcagattaccccaggatatccctcccagaaagggagtctaaggggaaaaaccactgaggaagggccatgatgtctacactggagccatggtagctatgagctgagctttgaaggctgtgggtctaagtgactgcaggcgtccttccttagctggggtaaatgcacagtataggtgtccatcacagacagggctaagtgtgcaaggacgtttattttgttaatgtgttgggactcgaatgtcaaaggcatgccacagggcaaggtgaaagctgccatgtctctctcgctcttgcttctcatcagcatcctaccctaaacattgacatggtgtctcttagaaaaggtgccgggtgcttggccatcacaggggactcacacattccatttacaagaaatgctgccttcatctctcaccctggtccgacaccgtctgtgtggatgcttcttgaggtgggcctaggcctaagccttctgtgttaggcttcctcttccctttacccacatccctgaaggactccagggaggccagggagcacaacagcagagagagttcttgtagccagcagtgactctgcacttgctgaggaacaatctggacctgcaagagcacagggaccgtctatctggatttcactgcatgtagcacgtatgtgtgaagagcctttctaatatatatccattcccgggactacagctagcagatcatacatttaacatttgatattaaaggtattatccatctctctcatttgcaattcagaaatgcaacgaagcaccccagtttgctatggaaatgtcatgggcatccactggtgagtcacaggacagatgttgtgacttctatctgatcggtggccacatgagcccttcctctgcttgtgatgacccttgaagatcagtgatggggaggaagtgacacttggagggactatgtcctcagagaggtggtggtaggagtttacttgctatgttaaaaccacagtgaggccatcttcccacatacctacccctccacaggcttcatccttctccctagacgctgcactgcatttgggaactgcagcttctctacccctgtggaaaaaactccactcatccatctattaaaatgatttacattttaacatctcaaataaatatagttgagcttaatatatagccaaaataattaatgctatttatatatgtttgatgaacttgattgaattgcctaaaaccacttcgtgttccaagcctgacctgtgcctctggaatgccatcttaggatcttcagcactcagaacagctcctggcacatagcaagtgtttcctgagtacctactgtgtgtcaggtgctgcagtggtgggcagaggtgagtgcctgtccttgtggcacttaaacctagtgtcttcttccaggcaatcaaagaaatggcactgattcagactgtaccggctggctttgtgtgtcaacttgacataagctggagttatcacagagaaaggagcctcctttgaggaaatgcctccatgagatccagctgtaaagtgttttctcaattagtaatcaagggggttggaggagggcccattgtggatggtgccatccatgggctggtagtcctgggttctataagaaagcaagctgagcaaaccagggggaagcaagccagtaacatccctccaaggtctctgcatcagctcctgcttcctgacctgcttgagttccagtcctgatttcctttggtgatgaacagaaatgtggaagtgtaagctgaataaaccctttcctccccaacttgcttctttgtcttgtttgtgcaggaatagaaaccctgactaagacatagaccaatatgagggaccttgacttaagggaaagtcataattactgacttaccatagctgtaagatgtacaaagaactaactactattaactggctttgtaaagaccgtcttaatagacagattcaagtgattagtggatcaaagcagcttagcccccatttatatctcattgatttggcttatatgtaaatgatacttgtaatctgtttgaaaatggctccttctctcctaagtcagtaagcgctctctgtgaaatctgtttgcacaattaattaacagccgtgttcaaggttcatttcttagtgtgtcacgatgtaatgacagacctcttcatctggggtcgcaagttcctagagaaaagtatgttatctgtgtaacacttgtgttttctggttctgtggctacatttaaagcaaggacagggatggcagctgtcacactggattggtgacagtcccttggagtttagttgcttttcccttccctggtgaataacagaaggggggtgtcggaggcatgagggaaggtgaggcatcttttctctcacagcccccaggaatgtctcaaaacagcggtagtctgtggttgatgcctggtgcctcctatgcctcagtgtgttctgcaagaattggaatcttcctctggtggattccagaagcaagggaagaaatcacacagggttttgaaagaatcataaagaaaccagatgtagcaagtgtgagggggttcattggttcattcagagtacaggcctaccactgctcatggtcagtcagctgtgaccttgcaaggcctcacagagaatcttcctctctgagcagccatcccaacctgggcagcttggtggaggtgtggaattgtggacttcctagggcaacaaaggccagagccattaatctattctccactgtccaaactcagtgatggcttactttaaccgctgataatccctgggcacacagacacaaatacacacatgcaaacacacataggcacacatacagacacacacacagacacacacacacacacacacacagacacacacacacacagaggcaagcacaggcagctcatgtcactaggttctgtgtggttctgtgttgtctctatttagtttcaactctgaagttttctttgtgttgtgttgtgtgtaaactaataacacagaaaagaaaaactgtcatgagtgtgtttgttaggactctggtcttttgtgcatttactgacatcttcagggaagaagtccttcaattactagatccttgtaacactataagacacaattcctgccctgctggtgtcctttttacaatgagaggatagcaataagatttaaattaaggtaagactttcccaaaggtgctaacgtagctattgctcatttatttaacaaggagaaatggcaagggcagcttcaggagctgatttcaggtccatatcaaggagaaaaatctcctgccttccagcccaagaaggtccaggtcacttaaacacatgcaaattatcctgttctcattaccatgtttgcccttcccccatcgtaaagcttttatcagggagaagagcaaagattggagcctgtctttaaaattcatttttagtatatatgaaataaaacattcggataggaaggaaaattctggatcccggcagtcagtcactgtcactactccatcttcagtacaaatgacaggaaatgtgaaccatgacatcgctcctatttttggtgtacagttgaggaaaaagaagtgggcctggctgcataaataatacgcattcatcactatgctcatctgatagctctataaattaaattgttagctcttccgggaaataaacctgtgtgaccttccactccctaattgcaattatgcctttccatgctaagttgattttggttgcttcagctgaactcacggagttgtgattggttgggtggtgtcttaggttttactgctgtgaacagacaccatgaccaaggcaacttttataagaacaacatttaattggggctgacttacaggttcagaggttcagtccattatcatcaaggcgggagcgtggcagcatccagggaggcatggcgcagggggaacggagagttctacatcttcatctgaagtcaaacagaaggagactggcttccaagcagcttggacaagggtattaaagcccactcccagagtgacacacctactccaacagggccacaccttctaatagtgccactccctgggccaagcatatacaaaaccatcacaggtgctttggggtttgttttgttttgttttgttttgttttgtttcttattctctctggctctatgagtttgacgctttctttctccagcctgtcaccagaggaaggaaatgtggagagatcattctgtctctttaacctttgtgaaattgtttttttctcacatgaatttggacttccactcagctctaggatgtgccaacctctgggctgcacagacttgatgtcactgagccctggtaggagcctggctcccaggcactgtcttgcagggaacacagtagacctaagtcatagaaacttgtctagagtagccagctactctgacatcctagcattcatcattcttgcagatggaaggagacctcttaggaaaatgagctccgttaaaggccactagcgagaagaggcataaaaagtctcttgtgaattaagtgtggggtgatttgtattcctcctgaataatgtgcttcctttaatgtggtgggttgtgtgggtgtcattttctgttgtctccttactcaggtgggcttgaaggggtaggtggtacagttccatgaattctagtatgacagacatactacatatgaagaccttaatttccaatctcagatgtttgcagaatgttgcagactgggtgagaaaacctcgaggctgttgaggaggaatagcctggtgtgctgtctcctggcctagctctcctgatgcatgaagggaaagtgtacagccagtgtcttcatggagacggagcattttcagattcacttaatttttcatacagctcttcaggtgaggaactgggtggtctgaaaagtctcaaggatagaaagatctccaggcataaggcctttccaggaaatgctcatgggcaagcctgaaatcagatcctgagtttccagggaaggtttttttttttttttttttagcttcccctattaggttataagcttcttgggaggaaaaaaaaaagaaagaaactgctttgaacggttttacataattcctttttgcttcagagtctggggtggacgttgaacactgcatcgtccatgctgagagggaggggaggggacgatgcagagaggccaagaacgtggaaatgaggagactccatgtgcctggtcctggccacttcttctctgtgcacaaattgtcctagaggacagtgcccatgctatgtcagaaaggtgacagtgcccaaggctggcccccatcagacaacacatactgttcccaatctgaatcttcataaaagccactccgtggagcctgtacctttgatgtgtaaggaggctaaggcacggggaggggagcaatttgagtagccatccatccatgggcagaagacacgggttgaagatttggaatgaaaactaaatcagagttggaattcacactaaggcagccttcatctgcttcccaaatctgttattgttcacctcaaatctactggctctgtatttttaggtgaatgaaaataatgtgtgtgtgcacgcgagtgcacacacacacacacacatacacacacacacacacacacacacacacacacacacacacacacatgcatgtgtgtccgagtgcatccatgcatgtatgtaaagagcatttttctaaatagacttttgaaaggctagcaacttttcttgtgattggggatggtcttggagcttcttgggatccccgtaattcccaattagcactgcaacttgtagaataaaaacaagaagtaacatgagggattctctctggaataaatgtcactgtttcaattaaccaaagagcactataagatgcattataaggccaggacaggactttttatcagtcttagtccaaaacctaccttttatcaatccgagcacaaatgagacaatcgtcaatgtcaaaagaatggcagctctgttttatatttctaatatcttaaatcctatgtctctctcactagtggctgaaaattaattataatttgctataattgtcacatttaaatgcaattgctaccaaggttttataaaggaaataggaagtataatgctgcttgtgttggcaagtctgtcttggcgcctaacccgctagtggacgctgtgcttgcctgttgctgatttgcatcaaatagaaaacatttcagaccttcctgatgcttcagtaaactaaaatgtatcattatggatgtgaaatcatttggcatgtgttttttttaaaagcaagatatgcattcttcagattgttaaatagttgctgaaatcaaaaacccatctccacccagagtcacttaaacccattgtgtccttccctgtggctttgagctgtagctctgttctccaatctgtgatgatgacatctaaacagaagtagtgattgtatttggacttccagataaagcttccaaaagcagtgatattcgggagcattttggaagtgttaagcacagatttccctcaaagccactcccccgttcccttggttacctgagtcccatgccacaaccaacaattcagatagcagtgttgccatgtggagctcaggggaatattctttactaacaatgactaagctggactggaaacactgggccaacggtagctaatcagaggggtggttttgcttcatgctttctttcgttgctgaaaccattggtaaaattaatgcccatttcttaactgagagctggttgtagcttcagttctcttggtccagagcgtgagtttgagagctcccgtgtccctcatgtggcaggctcttaggccaccacatgctcatcaccagggcctcacaatgaaagttcaccaccccagagcagccatctgagctgcgtatggatccttactatacattgcaaatccacaggtacaaggttacagcatagcagctatgactaactgtgggtgagagggcagacgactgagaccaagcggtgagttcagctcagcagacagagtagttggtactgatagccagcgggtaccaatggaggaagtgccaccaggaactcgcactggagaaggatagtttggccccatggagatttctgagttgagaatactggatcagtggcataggcgacttagaatatcaaaatctgttcaaagagcatactgcgagttggatgagtgccatgtttagttaccttcctcttgctgctttaggataacctgacaaaacacaactaggaggagaaagggacaacaggtcctctcggcgcagagggcaagaagaccaggctggcttagcagctgggaagcggacagagaaagggggaggggcagacaggaagtagagttagattacaaaccctcaaaacctgtccctggtgacgtacttcctctagcaagactccatctcctaaaggctctgtagatttcccaaataaccaagcagcgaccaagtatccaaatatacgagcctactgaggaggcttctgagtcaaactgaaacaaagtctgtggaaacacttctgggagatcggcatctcgaaggctgccatatccgtccttggtctacccttggctcacgtttctcccatcatgaatcacagggccttctgagtctcaacccatctgcttccccagacatgacccattttatgcgtcatctcgtgtatccctgactggccccctcttttctgttttgttcatgagctattaccatgtttgtttatgcttcaagggtgtggttaatttctagtgagtctttaggctatattagcataaggaacagcagctctcatctcaatggaacaaaagagttggcttattctggagctaaataaaagtgaccctggtcaggaaatataatttcaggttccctagatcccaggttctaacatggtatcaagtccacggggttttcagtgacaggataaagaaagtcatgaatcaagacccctttccaatcaatgcattggtgatgagtaggcagggtaggtgggtcacagagaagcagggggacctcagctagaggccccaggaattatctgatggcatctgtagcttttcaaccagtgggaactaggattctgcttatacactccataggatttacccctaatggtcacagagatgttagatcccatacagaggagggccgtagatggctatgaagtggacctgaagatgccccaagataacttggctctggacttgcaacaccccaacatctcttccccactgaagttctcatctgtcaatcagcctttgtggtcacagctttgcaggggtccatgctcacagctccttacaggtttagatcttggttgactgatgtttcttccctgagcctgagagcaattatgtgtccacaagttacacgtctgccatgtgcttggcagtaccatgttctgggtgtagtttgtcccctgaagtgacatgctacaaacttcgccatgttgagagctggtggattggttaagaggtgagacttaatgaaagagtgtgaggtcactgggctgtcacttcagggacagattgatggagtttgatcccttaaagcaaattattatttatcattattattttattttttgaattattatttttatgttaagaaagggagcatggccctcggatctacctgacttcctatctggttatataatctctccacatcggttcccaggatacatctgccacattgtgattgtagccaggagtcttcagactcaaagcaatgttggtgccaccattttgaacctccaagcctcaaatgaaataaaaatcattttctttgtaacatgcacagcctaagaaatattttttttgctttttgttttttgtttttttggtttttttttttttgtttgttttgtttgttttttttcgagacagggtttctctgtataaccctggctgtcctggaagtcactttgtagaccaggctgccctcgaactcagaaatccgcctgcctctgcctcctgagtgctgggattaaaggcgtgtgccccacgcctggctcagaaatatttttgcagcaagagaaaacaaaccaaaataggcatatagaactgccagaattaaaatatattaaatatagagcatagcagttatatgtgacaattccttctgcttttacctttataaacccatcctccatccatcctccaccattgattgattgatagattcattcattcattcataaacttacttagttttgtattccatattttctaagtatcaagttacttttgggaacactcaaataaattaaattcttttatctcttcttatggatcccagatactgctattctaaagagttaaataatcatacgttaggtagacaactcaaactaaaaatacctattattgttatcaccactctgctttatcgtggcagatgagaccagaatttatgcagggtaattggcttcctggctcgtcgtctgccctgttcctttttactgaggacagcatagtatccctgcagctgctcatcacaccgtggtgacagccagccatgcaggcatcagcgaaggcttgacttccctctgtcttaaacactttaatatgctgcctgcacagcatcctgcagttagtttgtgtggcaaagtcccagcgatgtgtaaacatttttgttcatccaagattgttcaagagcacacaaatatcacttgcttaagacacgtgtcctctgaaatagcaagaagtgatactttgttgaggggttgctatgaggggctttgctcgaggtcagatcatagccctctcctattcttggtcatgactgttcatctctgaggcacctcctacacagtccattcttctttgactatcgatgggtaaacttcatgcattttgaaattccagtgttgtctagcctttcttgggtttggcttcttaataggggatgaccccaagggataggcaggaccttaaagttgtcttgaatagtgcatatcctgtgaggtgtccgagatgagactggggactggaggaggggttgcaccagttacaactcttcttagttttaagcaacagaaaacctgactggtcttatgaaacaccgggagggcctctgtttcctatctcctggccaggaacacccaaatcctgtcggtgattctttatacactgtaacatcgatctctacccctgaccacatttccccaacaactgctgaagtttggagagagcctcccccacagcccaccagcaggctgctgtcctttctggtacaaaccttagaagtgaagtcccaagttggggctcagctcagagtagatggaaggacagagggatggcatgaatgtcaggcagatgggccatcctggagaaagctgggcagttgtgcacgagtcagtcctggtaggcagaacatcaggagtgaaaatccaaaacagaggtgtgaggtagttgtgcctgagctcaggtgaacccctgtgccaaagtgaaggcgatcatttacccagccatcgttaactaagtatctactatatgcatttttgcatatggagggggtgtgcccctgggcatgtgtgtggtgtgtgtgtgtgtgtgtgtgtgtgtgtgtgtgtgtgtgtgtgtaggtcagaggtcaaccttgtgctttctcgggaactattcactctgatttttgagtcaagggctctcactggcctggagctcacccattccattaggctccctagccagtgagccccagtgttcctctggtccctgctactctagcactaaggtggtaaacttgtgcctccatggttagcttcttacaagctctgaggatggaactcagtccctgagctcggggcaggcatgtcacctactaagcccccttcctggcccctactgagtgcgtttgaaatcctgtagcaatcgctgagcctgagctgttgctaatagataaacccaaatgatggtgtggagattcgcttggggagtaagttgtggaaaatcccagatactcctcagcatgttcatggcagctctatgaaccatatctcaagaggttgggatgcagccttgaggcagctccagccgcattacagcgcccagattccaattctttgatgttgatgaggctcgaaagaatagcttccattgctaccaggaggacaccattttcagctgggcctgtttgtttccatcttggtccactttggttcctgctgtcttgagttttgttttgttctgttctgtttgtttgttattttggaattttgttgtttgtttgtttgaggcagggtctcactatatagcccaggctagctccaatctcgtggcagttctcctgcctcagccttccacgttctgagatgacaggtgtgagctgtcatgcctggctcttctttgcctcttaatgcatcgcagttcctctccaagcttcagctcgggtgtcacctccttccccaacctaaagaagttccccacaagtccctgtagtctcttgtgttccattgcaccctgacctaaaacttctacagcatttcttttagtcccctgaatttgtcttccttccctttggggctctctgaaggctggggttgtaactggttgtgctgttccccccccccccccactccatctctcccaacacacggaaggtgccgagcaaacgtttattcattcagactggggagctacgacgtgaccaccatcctgcctttcttctctgaatgtccccttgcagtcactcctttgcccctgtttacttgacgagccgcatgatgctttgtgggggcataggggagactctctgtaccaagtgtcactcctatgccacctcagcccagccttggaaaggactgatcagggatgaaggtaagtgtgtgctagctttccggcaattttgagtctctcaaatcttctccaggaggcagagttcccatgccgatggataagaaactatacgtccctagagcggtactcatgggagatctccatgtgctccctctatgtgcttgctcattgggctgagcataaatgggagggaattctgtccttcctacccaattctagctcggctctaacaagttacaagggttttgatttgctcttaggttggtcatttcccttcaattggtatttttcagcattttagttcagactgaagttttaatgcccttcagatgctacatacaggcaggcaggcccatttgtgccttttactctctataatccttctctgtcttgccagcgtttgttggattgcaaaaggcgcttgtgtcccaaggactagttcctctgcactacctgagtgctgtgcacatgacacacagctccacatcatccatgaaaggggccctaactattcaacacttctttaactcactcactggaaattgtaactatgcactcaactcagtgcattgagcacctgcagtttacaagggaatgtctccgtggatggagacccatttgcccttggacacatacaacccctgcctctaaagactgttaggagaggagaaagatttttgagccatacatatatattgccccaaccacctctcctgagaataaaactccagctgtgatataactccattttaattctggcactctgtttggggttctcagggaccctgcaagtttctgaagtgtaagtacaatcctgtcaggccatcagctgccatcctctgaggcaatctgatgtgaagctgtcaggttgttacgcctgctctcagcggcatcctcttttctgagcacagccttctctctagctgcatctgtcatcatccctcagtccccacgcccaccatgcttcccttagacgctggtggccagcccacggcaggcggctgctaatgccctggactctcccatatgcctggagaaaagaggtgtgggctctggtgctcactttccagaccatagctcctaagggcagtcgtgtgggcgctatatgctacatgctatatgcctcatgggacacctggctgcctgcggtcagtgtggactctgaaagtgggtggcctccgcccctcttcaagaagcaacagatgccttagagccagggcaagcactttctggaaggtgtttcattgggtgccctgaagaatggcagccttcacagtttagaggtggctgtttcccaagatgggcatttgacagacaggaggccgtgctgaaacccagcagttcaaagctgcttccaacttgatcttggcttgtttgtggtgagaacacggtagtatgggcagacattgacagtacgtgggtgtgtggaagagaggaagaggacatttggggaacagcctgggcagctgcagatacagaggaaagctatttggtgtgtatattcctcctgtccccagtgaagagccagcctgaagggccaaggtgtcagcacacagaagctggggtgtgaatgccctccctaagggaccaggatggtttgctcagtgaagagaatgtcagagtattaccttaattctgacttagcattgggatttgaaatccacatagcaaaggtacaacttcctgtgtcttgggcagtagagacaatagctaatgctgatctggtcccgggactgagcacacctcaaagtgtttttacattcagcttttcatttacatacacgatacatttataatatatacatcatttacatatatggcacatttatatgttagttcattgacatacaatatagtaatataccaacttgtttacacgcacgacataatcatttacagttgcatacatcagctcatttatatgcacaatacagttacatgtatcagctgacttacatacatacttttacatgctagctcatctcatttctatacattagtgaatttacacacacagcacatttacatgcactaacacgaatgttttatttctacataaatcatttacatatataatacagctataccagcaccccatttgcatgcactaacacattctttatagtacatttacatacatcagtgaacttacatataaaatgtgtctgcatgcatcaaattacttttatatgcatatttttacacactagtcatttacatacataacacagctatgcagcctgctcatttgtatgcacaagacattcctatacagtcacttgtttctatatagagtgcagttacatgtgccaactcatttacatacacaatacttttactcaccaactcatttgcatacatatacatgtatatacatcggatcattttatatatacatttgcataccttaactcattagaatcatctctcttagagatgagagacctaagcctgttttctgtcatcttgcatctattgatttgactcaggtccattgtatacctgtgcacatcataacagtcatagtgtgaaggtatagctggttaactagtcatttcaccagccagcctgatgcccacagattcctgcctaggcagcaggcttgtcccccagggcttcccaaccctctgcaactcaccctagtacttcagatgctttgcagaactgcatctgtctccctaggcaactgcacatcactggttctttgcctggatcatacaagactacagtcattccccggtctcaaacagtctcttagaattggctatggtcaggctggaagcatttctcctttgtaccaagtgcccacctccaacaacaaagcccaggagtttcttacataatccacagacagtgtgctaggggcagagagaaactaagaggaggaggaaggacaggaatcagtatctagctcaacaatggtgtgatttgcttatattcactgtggaaagcagactcttcaaagagcaaaacttcaggagaaaagaaggagtcttcctgggagtctcgggaggatttagcaaagatcttatgacgctgctgtgttggttcattccacccaggaatgggggcttgggtcctgacaatctgttctgaattttatacacaatagttgtccctatggtggtatgttggccagtcaccttctgtataatactgtttctcaatacacctgttggcctgtggccaccacttccagttctgtctggccagactgtcgtagctctgtggttcccatgtgtgctaggatctgtctgtgttctggccttctccttctgcactgagcccttctccagagcacagtagggctacaacatggctctggacaagcttttcttcccctttcacacagtaggagcacagcagtgtcagctactggatcgccgtgtgttactctatatcaagtatcttcctcagtcactaaaccccgaactcctttttctggagtcacggtctctcactggaacagtttggctagatggggtagtcaaaagccccagggatctgcctgcctctgcctccccacctctgggattccagatgtacacatcctcacccagctttttacgtgggtccagggtctcctagctcagggccttgagtatctcacttactaatctatctcctcacctttacctgtgactactgcaccacacactgcttctgttgtggattgacaagagatctgcccagttaaggaaagttatttggttcctagatgtcagagcagaggggctagattttcagacagacggagtgtctttccctagtgttcctgttccaatgtgaactgcttcacaattccctggagactggttcttctggagaggtgtgtcactggctttggccttgatctctcagtgacaggcccttctctggtatttagagagctgtgcagtctctcagaagagttaccacaccagctcttgggtacagggaagtctattccttgacctcctgtcattcacagatacagtctgtgcttagcagaggtcacttcacgcctgcagtgtattgtcacagattcttctgtgagcctgtagttcacatgctatgaggatatttgcccttctccgccctggagagaaacaggaaaatgatttcctggtgagaaatcaggcacttgtaagagccagatttccaaagaggcaccgctgtcaggggggctaatcatccaaatgacgggcacgcatggctgccttccatctttctgccaccttgcttgagacgagatgagtgggccgtcgggccagcgatggggaattctgttagaacaacatccgcagggaatagctttatctgctaaggatgacaagtgaggccagtgtacacaaagctggaatggcatggccctgcttggcaaatgctacaagacccaggactggtgtatctgttctgggaggcaggggagacgcctctgccaccctgggggtggtggtctctgggcactcttttcatgtggcctcttggcagcagtgatgagctcaggaaatggaggagatggatgatgttttcatgtttcagaccctgagtgatccattgtttccctcttcactctccgtggggatagagatgccagcgtagcaggggtggtgggttggtggggtattcctgccagcaaggcctgggcaacatctgcattattcccaggttgttctctggcaccgcagccgtcacctcccactgggccacccaactctgcctctatgctttcttgttgctggttccgggacatgtaggaatgttgccatggcatctctctaggagccccttaaatgttcctgcccagccatagccacagagacaggaggtagattaggtttccaaggctttggggggtaggaatagagtcactcttggaggcatggagtttcttttgagggtggtgggaatattatggagtctagatgtaaggatggttgtacatttaaatatacttacacacacacacacacactgatttggggctgggaggtggttggtgaaggacttgctgcacagcatgaggacatgagttcagatccccagaatgcctgtaaaaatgctagacatggtggcattagcctgtagtcccagtgggtccctgctagctaggctgtttgggtagttcagtgagagacggtggcacaaagcaaacaaacaaaacaaaaggtaaattacatctgaaggaagatacccaagattgtcctctggcctccacaacgcacacatgtgtacacacacacacactttgcttaaagtgggaaattctgtaatgtgtaagttttgtctccaaaaaggtaaaaggtaaattaaagtagaaaacctaaatatttagtcctgtttcctgggagaatcacccccggtgggattttcttgctcctctggtctgtcccatgctaatgcccaagttcaacttaagatataaggctcgccacatagcacatcgtttctttctatttactatgacctatgaaacccccatctagacctggatgaaagctagcagagtcaccgggccctcatgcagcttgaatgcccaggtctctgtcaggaagcacgctggctagataagaagcagaaagcggaacccactgttccctgcctcctgctcagaacactttgattctctggtgtgaatgtttttataaatatacacatcaacagagttcttgacattctgcccagacctgaagagggacagaagctttctaactgagatggaacacacggagaataagaaacaatcgaggaagaagtcacaaagactgaaggagagatggaggggtccacctccccatggcccctagtgggatatgtagggtacttaggtgcaaatttaacctaaattaaaatactgacttctatgcattaaaacctaaaggtttgcctaagccatcacattgtttaaatacatggatgaagattagtctccacctgaaatcagttccctctggtcacctcactgctcagtttagctctgtagtttagtcccagccccctctctccttgtgtttttgcttattggccattggctgaggtagaaacacagatcttctatatgtcctttggagaaatgaaggccaatgttaagtcagaacttatccagttccagcaggtaatcacacaagaacagggcttgccaatagttggagttgcaccagaaggagcccatgcaggagacgcagccgctcacaagatcttacccccattactactggggctagtgtctcctctgagaggttctggatttcagtggagggtggagtcaattgttccacttgtttacagtggggtcattagtactctcccttcttctttctttgtttgcaaaggctaaagaggtgccaccttcgggggccagcacaggatgacagggagccgaggtggctcttcccacccttacatgttgccaaccccccacttttttttttcttcaaagaatgctgagactaggaattatgattttgagaaagatcattattctagcttctcaaggaaaatgatgtatttacaatttcctgtgcatgcttagatggaaattagattttgttcagtgccttgatactggcttttctgtttacattacaactcccagatgtgtcaggttgctgggttgttgactgcatcctctaactcctctcagagagtggagcttttcaaggcatggagacttgctcatgtgagcaatgatgtgacaagaagacttgaaattcataacattgccaccatgttaacaaaaatttaataaattttcatagggagaaactaggcatgaatagaggttatctttttttctcattttcttttgctttctttcttcctttctgtctgtctgtcttctgtttgtttgtttgtttctgtatggcattcttgatgagtgaattatgttgacctaccagaccatgttgaccatagagtgtgcaggctaaactttctcctgtgccttgcattagcagtgcttgcccggagacactggtgctgagttgatgtccttaaacccctcacttgggaacaaaactataggtgaggccctgaggagtatggtcctgaactgcctgtcacctcatgatttacagagtcagtatcaagattaccactgttgtctaaggagccaagacttccacaacccaagacccttcaaaccctgagattctgcaaaccctgagaccctgcaaaccctgagacccttcaaaccctgagattctgcaaaccctgagaccctgcaaaccctgagaccctgcaaaccctgagaccctgcaaaccctgagaccctttaaaccttataatcctccaagccctggcatttgaaaagtcagatcatcccctctgtgccccatttcccccaatcggacaactgtgtgtgtgtgtgtgtgtgtgtgtgtgtgtgtgtgtgtgtgtgtgtaaatatgaaaatgaaactctggagattcttaagcttggggttttggttttgtgtttttgtttgcttgcttgttttgttttgttttgttgagacaaagtctcgtgtagcccaggctggcctcaagctccttgtgttactgcaatcggccctgcactctcgctatttctgcctctacctccagccccagtgctgggattgcaggtgtttacctccacagccaacctgggtccagactgtgggctgtgaggttgggtcagcagctgtgagtcacccagagcttctgtgaacctggaccccaggtctgcaactttgtatttcataagcaaccatgcatccatgagcattgctgctgctgctctccccgctttgtaatcgtgtttttccttttccttagctctggggtttcaatgtaacatcttagccgtcttttagtatcatggaggcttgtggcttttccagggtggacgtcaatgctggagccctctaggaacttcttgtctttagcccttgtctgtggacagctcagtggggcacctctgcctatacagcagcccctggttgtcatgtatcctgttgagaactggtcacctgctggctacctcgaagcctgcactcagtgtctgaccagccaagaggttcccttgggcttcccagaactcccgtcttctgtaaggctggggagggactcctttatccagctcttccagtaacgcatttcctcaccagtcaccactggctagttttcagtttggcacatggtttagacaaagaggattttgtatgtatcacttcccaccagactctcctaagtggaagcctgggatttggaaactgaggttgtttttctgctctttaaatgagcgactttctggacacaccttgttaacacagtgtagttcctcacgtctttattacaagagggactgcctgagcccatcgggacattctcttactattaacatgagcgcctgtgatcccgtttatatacattagaaaattaatttttgcttctcagaatcatgtgtgatgtgtggctcacatccaagattaatgtaaaattatatactttcccaaatatttcatctacatttcagaatctagttaaaaaaaaaaagatttccagctttcattttagcatgtgagaaagcagagatctagaacaggggccttcagtgatagtattgttaatatttgagccaagtaactgtgtgacaggagatgcaggggtgcctggtgtcttggggaatactccgcagcatgcctagtgtttgctcatttttaaaaattctttgagtgaacagcattgtctgtgtttctgacttacttctttgccaaacatttggttctaatccaggggagaacaaattagattaattcactgccattggcccatggatcataattggagaagaacatcctagaacctttgcacaaaataaataagtgaatgactagttaactgaatgaatgatttgtattcacctctacagttggaaggctgtaggagatggggagagagcctcaggtgggggcaaagagacatcttgatgttgactaaaaacagtctgatgggatccctgctttgtgctgttcctgtcagagaacggccatgactgtaggaagaaggtggaacatttgatgaaacagcagggcttccacactgtcagcccccattgtaactgaagcttcacacatggtcctcatttccctccaccatgtttttctaggtgggaggagggtctgggaataataatagtgtcagccttaaacaacccaccccacagccatgttctgaacatagctgctaacagtgggaaagggctctctgactgacagattgaagaaggactcacccttaccacccctatgccatgagccatgttctgccacttgcccgtgggttaaaccagagagtcttccattttctgcctctgctccaagggtagccactgcctgcaaactgagtcttagagaagcagtgccggtagctacccatgaacctatggaagtggaaaaaagagcctccagggtctacaggaaagggcacacctttgtcacagcaaagtcagtaaagggtctgtttataaaattatggatagggtagaaacaaaagggcaaacctgagagcccagggctggcagtagcaaagcccagagctccccatccaaggatctagcagttactcagtctcacgcagcaagcaggcgaaggagcaagagcaagagctagactcccttcttccaatgtccttatattgtctccagcagaaggtgtagcccagattaaaggtgtgttccgccacacctttaatcccagatgaaaggcgtagcccagattaaaggtgtgttccttaaactcggagattcaatcttctggaatccatagccactatggctcaagatcttcaaaccaagatccagataaggatctccaagcctccagataagggtcactggtgagccttccaattccggattgtagttcattccaaatatagtcaagttgacaaccaggaatagccactacaatccaccccttgtcaacttgacacaaataatatctcatgttcacatgaaacaataacaaggttgtaaatatgcctaacatgatatattaaggaggatggagaagggtagaccgtaaatctggagggcatagaagacattagccaccacagatcagtctctcagcacagccctcttcgcttcctgggactcacagatctccttatctgaaccctgccacactctgtctttggagagaagtctgggcgaggattttccacaccgacctccttcctcattctgccgagctgtaataatgggcagagtcgctcaaggctatttcaaataatctcttttgccattgacaacatgaggtttgttctgccattaaagtgacacaggccctggagggggagaatcctatgttcattttctttcatccattttcttcagtgtgcaatcatctttctcagcagcccgcatctgacagttctggctgtgtgggacacagtgacacagttacttctttggtccacttgtctgctgggttattaaatacagattacacatgagaggagaaattgaactatatactcctgagtgttacgcttttgggtttgggtctcactaccatggaacttactatgtagaccaggatggccttgaactctcagccgtgatagtattaaaggcataggtctcttgagtgacattcagaccatcgtttcttcagacacatcatcaatgcccaggagacctacaagagtctgatctgcctgaagaatacccaccaggttctctatccatcctggcctcaaccaagttcaaaccacgagctttgcttttaataagaatagcactaggttttgttgaagattcattataattgtcataataataaagggagatagaagattctgtgctctcaattaccagaatctcttgtttattgcttgctaccttccacaaacaaacaaacaaaaatcagaagtcgggaatcgggaaagaacagggcacttgcttggaacttgggcaggaactgaggagaggatatggtccaacttctctctgccttctctccagtgacaattgttagaaaagatgaacaaaaccagagagggagtgtgtgcagatttactgtgaggtgagaactcacttcccagaaatggctgctcttctggtttcaggacccacaccaccatgggatttctaagacatcataattatttaaagtgctgttttggggactggagacatggctcagaggttaaaagcactggctgttcttcaaaaggtccctggtttaattctcagcacccacagggcagcttacaactatctgttactccaggtccagtgaatctgccacccttacacagacatgcatgcatgtagaacaccaatgcacataaaaataaagtgctctctttaagggtccctgttacactgctatatcagcacccagtagactaaggcaggaggattgtaaatttaaaaccatcctgagtgtcttagtcagggtttctattcctgcacaaacatcaagaccaagaagcaagttggggaggaaagggtttattcagcttacacttccatactgctgttcatcaccaaggaagttaggactggaactcaagcaggtcaggaagcaggagctgatgcagaggccatggagggatgttccttactggcttgcttcccctggcttgctcagcctgctctcttatagaacccaagactaccagcccagagatagtcccacccacaaggggcctttcccccttgatcactaattgagaaaatgccttacagttggatctcatggaggcatttcctcaagggaggctcctttctctgtgatatctccagctgtgtcaagttgacacaaaactagccagtacactgaggtacatagctagaccctgtctgaaggaggagaagaaagataaagaggaggaaaaggaggagggaggacagagggaggaggggaaggagtgggaagaggcagaggaagaagaatttcttgatagagagtagacagattgacaaatatataataaaggtttttttttttgaaagaatgaggtttgaaggtgccatgctctcagtattgggggctaagggggtgttcctgtttgcaagatggctatcagggtctcagtcttcagagccttctcttccaactagagagtccacagtctcgtggacctctagagtggacagcatacatgcaatggtgctctcagcttgtctgattgttggattgaagatggcactttgcttctttggacctcagtgcattgtctgataatgtcatgcagtgtcagctccattccattggtggagtgacttagtggtctccttagcactgcagtgctaatgggcagttatatgccggtactaccaagtcttgaacaggaatcatcacggcctttggaagtcaaatctatcagatacacaaagaagaagaatgctaaatttgatgtcgcctggcgccaacctgcctcagtctgctgagtgattcgagggtctgtttgcagagagctacacaggttgtgaatttatggtgtgcccagcaagaggctcagtgtatctggcaatctgtcaataaactacactgtagagattcgagtaacacagcagaatagtttcagagacttgttacaacccatcaagtcggataatttacaactttaggaaaattcccccaaatacaaatttacaaaattttgagttgttttatactttctctatcagaccattaacctaaaattaaaagtcctttatgctaaatcacagcctaggcttttaattttaagtttaaagtatgtttcagcaagctagaccacaggaacatgagggtaaagagaaaaaataaattgactctagagaattccataaaacttgccaaggcagccgtaaatatattcatggtgaggtctgttttgtgtacaatttatatgcaattggctggctcgatcgggaggatttatgctgctgcgttgcttcctctttgcaagtaggcagggtggcagacaggcaaactcacagatcatagagccgcattgaggtttcaatcccatttcttgaatcatagtccttaaggggagaggttctgctcttctttttaacctctcttccatgaaagggcagctgtgagcaaagcagagattagccactggtggttatgtgttgagcctaaatcatatccacgagatgagaccaagtatgagagtccccggtaacttcaaagcgcccccaacagactcaggactctgacaggatcgccttcatctcttctgtaatttcaggctccccaccaccccatgttcacccagcaaggctacccgcccttcccgtaccaccctcccctagagatacacaaaggcaagagttagcatctgagcatgctgccttcacaacacttggacctaaggtgccattcttcatagaacactcgcccttccagtctccttttatctccagagtcttcccagtaaagatctatttctcactacttccaaccatgcttcttaagttccaacttaaaagcattctggacctatagaactgagtgctcactgtgcaaaaggtatcatcagtgacattaggctgtaaaaagatgtataagtggcaggctcctgcacactcccaaaccaatcttattaatttggaaatgtgtgcttcacttatagcctgactgctgtgtaatcttcaaatatgaatgccagccacagggctcatcccactgagagcctttccagcgcgagccacctgctactgtctggtcccagccatacacctccattctaaatttgaccttctcagggaaagtcattatagcctacgtgactccatgttgatagctgaatgttttttatcatgagtgagagtttattcaatcagctcattctgagtggaggtcaccagcagccctttcagggctgcctgagagcgctttgttgtctggattatgtcatagatgggtagcatcataataagattcctggtacctgattgagcatcgagatgaatctgggttatatcctctttattttcagtgttgacacactggcaggttgccagggtttatgtacccaacagtgaatagtgttgtgtcagctctgccccatccagacaggcatatgttttcagtgacaggttccatcaaattcaaatgtcaatctggaggaattatgactgagtgaaattatcctaagccctcagcttttaaaatctattttccacatgaaataaatattgaacatccatattagggttgtctaaaggaaatgatctggcagagtgaatagctatatctatgcttatctctatctatagatggatggatagatagatagacagacagacagatgacagatagatattaaagagggattaattaggttgcattacaggattcagtccatgtattctaactatgagtgtcttgcaagggagaggctaagcatatagtagtttcctccctgcaatcccagtttggcactggaggcctagagtccttccaagctgctggtcttcagtctactgttggaagcctgaagaaggaggctctgatattggtgaaggagtaccacagtaacaggatagaagactttgtgagcaaaagtgagagcaggcagacaaaattcaaagtttccttctcccatgtcctttgatccaggctactgcccacatttagggtgggtctcctccctgtttcaaaggatctgattaagaaactacctcacagcagtggtccagtggcttgtagttgtttagttaatttcaaatgcagtcaagctgacaaccaagattagtcatcacaccgtcctcctcaactgtgtgtacatattcattctagaaactgtcaaatacaatcattaaacattatccaaagcatactaactcttacacatacacacacacattcattcacagcaatttgtgtacattttattatatgcacaccataagtacacgtacccttgcctgcacatttttgtgcacatatacacaaaagcacacagtcaaatttgtggtctcacgtacatacacttacacacaaacacatacacactccatttcaatgccaagaggaagagtggtctcaaatagttgttagtttcttttaatattgatttcccatgtgcattatttagtaagaagtcaaataagtgattaagaaaaaaagtcaagactatagaagaattgggtttattctattgtgggatgtttatgcttcaataacaacaataacaataaaggtgaaagggtgtgatacggaaccactttcaactgaaaagttcctgagccagttcatcctttcagatgctaacacttaacccagttatacacagtttcccctcaagaaagctgggagtggggagaagtcactacagctttgttgttcttcagtgctgggggagcccaggggccatctgcacgacaggcaagctgctaccactaaaccacccagacccctgcatagaaaatttctttcaacctggtacctggctcttaaacattggtaaggttgtcatctcctaaaatgtaacactcacagtccttgtggttttgattgacattggggctgtcaaagagtcgttccgggatgaggctggcctgcctctcgggcagtggttctccaaacatgtctctatggccacacaattcacatgtgggtgaaaaacaggctagaaacccctactgtcagactccacccaagactgactgaatcaaaagttgtgagaggggacccagaaatctgtctttcaactcaggtaaaaccttaaagagttgttcttgagtaagaaaacttaaatcttccttgtgtgcatctatgaaaccagttccctgaaacctgtgcttacttaggcaaaaaatgtctctgcagggagttcaggtcctggggctgttgccttccaaaagttgacagagtaaagaataggtctaattactcttttgtgatgcaaacccagtggatttggagtccaaatggagaggcatcctattggtccccctcaaaggaggagccagtaccactgctccctccactggagaaaaagatgttgcttgctagctattatcaatatattctgtttccgtgtctaagacatcaatatgttgtcctccatggcaagctttctcttctgccttctgaagcagacctatcttaggttccttccttgaatctaaacttttttgtcatgctcagttctcctagataaaggagagtgggttactaatcagcatgaacaaatatttctctgtctgtcacctgctttctcatcccccacaccatgtcacatgaccagacatgtatttccataagatgcaactctgcacctgtgtgtcagctccccagccttcacgcactcagtcagaactcacactcagatcccatgctttaaaagtacaacctgcgcaccttcccccttacctgcaaagctgtccacagtggaaggaggcctgtggccttgatagcattgctttacaaagggagaaatcatgatacctggaggtatctgctgtcacactgagaaaggaccctccctctcctccaggtcacacagctccactgtctctctgctagtggcgactatatctgcagagccaggataaagcctccatcttctttatcagcatcctggtttttgaggatgctggttctgtgctgtgcagaaggacctgccaaggaagtgatgttaacactcacagtagggccagcatggcttgagagcatccatcttctcaggggacagttgcgtccgacattctcttcataccctgtgtgctaggaaggctctggaattctcacgtttagaacacagctttactgatcagcttcctttcatttaaggtttccatcccttctcagtcacagagggaaagctccatctcagccttttaggtgaggaggattgtcgctgtttgaagtgggttgcaatttaattctgtgttgttgctgttagcttcagttcttagcaaacacaagggagtaggccatgattaagcaaattgtatgtttactaggtaattccctccctagcctctaactgatcttacacacacacacacacacacacacacacacatggttaaagaaaagacagaaaacacacagctttataatctttttccatattagaacctgcccatgagcttcaaacttgtctcctattgccagcaagggcctgtctaccaaggcagagggtggtgaggaaattgtaggcaccagaagctgtcccttgggggaggtgacagagggtcatgtctttcccctcctccttacattatgcctttcaacaagatggcagcaggaagcatgaggcttgcctgagctaagcctaggattggaattgttttagttccaagatgaaacctagagagtagagaaacccttaaacaaatggtagtgtgcctttctctttttgccatgttcctcccccttgcagccctggcattggtgctgtgcagagctgtgtgaccagtcagtcacgctttagtagatggaacgtgtgcacttctgaatgtgaggctctccttcgagacactagtggaagaagacctggggtagccatggttgcttcctgaaccttctcactcttccttattgttgaaactccaagacctgtcaaggaataaggatctgggaccaagacattatgcacggtctttgttccagctccttactcttcacttcctctctttctatgtggagttgggcatgagaacacagagttcgctcagtggtctattgagagtgtgtcaggtttcagtgggaattaaagttatccataatccaaagctgtcgatgagatgattccaggttcttggcctcagggctccctctgacgtcctttctcctgggatggtcctctggttcttttcttcttccccagactatggctgagagctttgggcctttctaggaaaggctccccactcctgctggatcctagcttcccaacaggctctgagatagatgcctagcctctgccaccaggctagagaggcctacatgatgaactgatggggctttatgctgagttacctgcccttagtccctgggcagcctcgagaagccagactagtttctccctcctaccgatctcctaccaccagttcctgtgcagctgccatttattcgtgtgttactagcaggagtgaggttgtctcctgggagctgcccaggtgataaagcctgggagcaagtctgtatactgtcctcctaagatggcttcataaagcaaatggactaaagatgtacctgcaaggaagattcctacctaagaattactatgatagtcggtgctgacacttttatttcagataaataagttatttataatagaatctgtgtgtctaggtcaataggccagaagcaacgagatattgagattcttggggccaggaagaaccccagcagtgagatactagagacagcagagcaagtgttctgtagcaagctgaagttttccatttgatatagagggttccagaagaaaacactgctttcccattgtcctgcctgttgttttccaagtcaatcagtggttctccggtgacagccagggctgcaacaccagacacagcacttcttaagtcttgcttgatctgtagctgagctcttggtggtagcataagcattggtaggaaacaggccctttattgataggaaatgccccaaacccaaattgagcacatctgaaagcattctgactttaagaagtggtcattggtatctctctcaaaaattcctttagtgatattttgagtgcgtgtagtaaggtgtgtgtgtgtgtgtgtgtgtgtgtgtgtgtgtgtgttacattactagggcttaaacccagggcctttcacatctaagtaagcacttcgcgtctgagccacatcccaagctccacttcttccttttccttttgatacagcttcttactaagatgagaaagatggccttgccctcactctgtggcccaattagaccttgaatttgcaatccccctacctcagcccctcaagtaactgagtttacaaactcacatcactatatatgtcttatttctggcagtgagtctcatttctgcttattcagaaaatctccaatcattatcagtcagtatttattaaaaatcaggtaaaggggtaggagctgtaaggtctggttcctataaaaatctggggatatcatggaatcctaacagtaatgtgtcttaaacaagaactgtacaatgataacagcagtgtagactgggaaatctcacaaggctccccagaaagagctataggcaattaatgcctatttagggagatccagttgaatccaaggatccaagctacctggtaggctatcccatcccaaatggtcaaccctaaactcatacacatatgagcaactctacatgagcacagcaggctgtattacatggacatgtgtgtgttgtgtccaggacagccatggctatacagagaaaccctgtctcgaaaaacaaaacaaaacaaaacaaaacaaaaccccaaaaaaccaagctaacaaacaaacaaacaaacaaaaaaaccaagcaaacaaacaaaaaaaaaaaccaaaaaacaaaaaccaaaaaacccaaaaacccaaaaaccaaaaaaccaaaaaaaccaaaaccaaaaccaaaaccaaaaaccaataatcttaaagaagaggtcatgaagttaagggggtaacagggagagtggggtggggagaaaatgggacagaaatgatgtaaatacagccttcacacataagattatcaaaagtaataaaaaataaagggatttttaaaaacaaaaaaaattaacagcactatgaagaaaaaaaaaagatgaaccacctttgagaacattgatgcacttaagtggaatattgagccatacactatgtcataaggctcatcagtttccactaaaagtctgtatgcaaaaaaaaaaaaaaaaaaaggtggggagagtgatcttgggagaacagcatagaatacagggactagggcctcctggactcctagataagctaagtgaaggaagagtcaatgagaaccctcagaggtcctaaggctcctctgtcccatggttgatgttgcatgtttatttgattactagttgtgtaaatccttatcatggtgatatggagcaagggctcacagcccaaagtatgtagaagcaaatactgtgggacctggcttttgcaaagagaaaagattttgttgtgtgctcaggacacaaggagttcaaggactgccagcttaagtctgcctccctatccattggtaacaatgtatatagacaggagaggggaggtggcacttgattggctggtgagagcagtttttaggccttttgctcccccaaccccgacctctgcctcctctcattgtgtgtcccaagcttgttgtcacattccgcacatggcattttgagcttttcttgtcaaaaggcaagggttccttcggcatgtgtcactcatgaaaatccggttttaaggcatccttgcatggattctggaagactttttatagaaaacaacttaagaacttggttgtttggggcattgtagctgagtctgttcatccattaactaatttcaaaagaaaatattgtttccatttagagacagggaggctaccaagagccagagtctgtatgacttgaaggttcatggtctcttcagtcggcccagttaccacagtagtgactgtgaggcagtagcagctaatgccaccatgtgtgtactctgtagtccctggctccatacctcagaaccctacggctcttgttaccagtttatacactggacaccaaagagcttcaatctcttgtccacagacgcgcatcagcgaatgatctagatcccaaccctgggagaccttctttgtctccgcagcctgtgctccaggcccctagctgtacatcccataaaccacagggaggaaactgacggtgaccaaccttgacactggagtgattctcctagggaaaaagccagcatcccaccacccactccgtcaggcccaaagatgtctgtcttagggtgtctgtctgccttagagtgttttgacaccagctcatccatttaaaataagtttcctgaacacaatgagctaagggttggggtgacttctaaataggctactgtcagagttccagtccttcctgacagactggcccctgagatgtgtctgcctcaccctcggctgcttggcctgctctcttgctagtctcctaattggtgtgagggactctgttccccagctgccagccattagcagggtttcgcagggaagggctttttctccccactgtgttttgcagtccctggctaggcttgcctggtgacagctgcttgctgatgccgggctttatggaatcttctaggccccctccactccccgaagccctcctttattgagtacatctcattagcaggctccattttctggtctctcacatgctccctcacacttagcttcattgtgcctctgcttgtcaccttcgccagcctggcttttaataatgtaaatctcccctctgatggcatggctgctcgttacttgctgtctggcgccacacaaacttacctaatggcgcctctgaaaagctgaggctttagtggagaaactggcccgctccttccccacatcctcaagggtactgcagctctgtatttgtcccagaaaagaggatcaggtcaaggccacagccaggctttgggcaagacgctggagtcccaggaccagaaatcccagtgcggagctaaggagcatggtagttacaaggacagtggtaattctttggcagagcagctgtggggaaggcacatgggaaggagataagagccttcgacaaacatcgaggtctgtacaacttgtcaagaagtcatagcaagggtgccggtactaaactgctcttgtcaacacagactgtcctcaggaagcctgagtgagtacatctcagcctctaccctccaaatgtctcacaccaaatatggactctgtggaccaagccccatactctcaggacacttcctgaaggatgacactagattcaatccaacaggttatgtaacccacagctgaacggtgcttccagtctccgaggtctctttaggtgtgattctgcaatcctgtaatggccattaggctttgatggagcaatgccgttgtgagatattgtttaaaaggtctaactgtaggaagtgcagttgtctcacttctcccctgcatttcttagcgttggagttactagaagcctacaagccttacaccgaccaacaggcgcctcctggtcctctaccattctccttgaacccttcagtctcatgaaaccataggggtttgccttcaggaaaagccatttcagggctggaaagagggctggctgtaaaagcatggggacctgatttcagatccataatacccgtaaaaggctgggcatggccacgtgtgcctgtaacctaggtgccgtgggagaggagagagagagagagagaggaatcactggagctttgtggctgccagtcaagctgggttcaccgagagaccttgtctcaagagaataaggcagaaagtgactgagaagggcaatcccgcctgtgtgctctgtggccatggctgtacacacacatgcacatgcacacatgcaaacacacaaaatgcagacgcatgcatgcatacacataaacacacactcatgcacacacactgagaaaaagacacagacagacagaaatgcatacaggcagacaggaagactcggagagagacagaggaaagacagacactgagtcaagcagacacaaagagagacagaggaaagacagatatatatagagagagacagaggtgagacagatagatatggagaacaaaaaaaaaggaacaaacttcatgtcacttttagaaatgttatcagggaaatatataaattatcatcttgtgtaaaacctgattttaatttactttaatgttattgtcagtcatctataaagctaaggagacatctcagatacataagaggggggaaaaagtcgtgtttgtggagtgcagtaccccatgacaggctagcaatataatcttccattatgatacttaaagagaagggagccctttaaataatggctggggaattgcacccttaatcccttgcagtgaggttttagaaatgggcacttcatcaaagtcttccaccacgtatttgtcagcatgtcagagcatggacagccgtggagtgtggccgtttccctgatgcagcagcagatgctgtgtgtgcgagaggcacacactgggaagtgtacactctttaggtctcccttctctccagtatcatctagaatgggcaaagcactgtgatcagagagagtgagcccacccatcccattgcctgaccaggacagagaagaaagggataaaggataagaaatacctcacttaggtgctgagatcaaacctcatatggatgacttactgttataatatatacatatatatatatatatatatatatatatatatagttttaacaggaggtaggaggaaaatcatctttatttcaactctttgtgcttaattttgctttataatatctttgtgtggtggtggtgagaggggtatgtacaaccacacagaggccagaagttgactcaggctaggctggctggccagtgagctctggagttctccagatctgccactccctcttccccacccccacgttaacactggagttacaggagcataccaacatggctgactttttaacatggggctgggatttgaactcaggtcttcatatttgcacaacatccgctcttattcactgagccattgccgcatccttatctggtgttaatctgacgtgcacagtctactttctagcagtagatcccaaggaaaggaacctgttgattcccccaatccctgaatttgtaccttccttcccgaagataatacacctgtccctcagtatctctgggtaaccaagcctgggatccctgcatatactacagtgcacggatgctcaagtcgtatatgtaaaatggcatgatatttgcatataacctatgcaatcggcctggacattttaagttctctgtatatcagttataatatacggcagtctgtacctgtgtacctactgtgtagatgtttgctgtgtagatgtgatactgtaccatttgggagtgaatgagaaggaaagaagtctagatgctcagggcatgtgtttccttcctggtcttccaagtctgtggttagttggatgcaggtggacaccacaggagcggggagctgactgaactattttgttctgtgcaccgcttaataagcagtcttcatgcctttgttctccacatctgtctatcaagggaggtggcacagagacctaccttacggatgtggatgccaaggcccacacacgattatcaaccacagactggtggtgatacgtcatgggtgagagctccgtcccactccaggtttgctccatgtccatcaaagcccacacctgtgaggtagcaatggtgaccatctaagtttttctcttcatggttggatctatctaaattaggagagagccaggaaaggcctccagatttacctctagggcagcatggccctgtttttcaccatccaccttctaggcaggagttacccgccccccctcatctgagccttcaacctacatgcgaggcttagggtgctgtgatcagtatcctgtcacctgcctccatgatgaattctggcccccacccctgccacttgccccactgtggagaaaactagatccttggttggaattacctactgccaagcattgctgtttggttgtgttgcctaaattaatgacttcttagtgcctgtgctcgcgcgcgctcgcgctcgcgtgtgtgtgtgtgtgtgtgtgtgtgtgtgtgtgtgtgtgtgcatgcatgtgcccatgtgtaatgtacatgtgtgtgtgtgcatgggtattgtgggcctcacttatgttaggcaagcattcgactacccagttaaccaacagctaccttggcttttagatcctcgtctggcaattctctcctcttttcccatcattcttcctgtggtgacttttgaacaacctatctttctgagaccttactacacagccttagcacataggctatgttggcctcagattttcagcatcctcctgcctcttcctccagtagtagaactgccagtgtgcaccaccatgtctcgctattcaacctgcctctggttttcctttggggcaagtttctgtacatgggctatatgcatcatgactcaggttcccacaaacgtgaagtcttaaagaagaccctgaatgtggccaaaaggaatactgaatggcagtttgggacagttgctgcatctacaccttgactagtttctactgagctgattcttaaaagtccatgttaagggaattagaatacagtggaggtgtaaaagattggaaagatgcagtgattggctgatctaatgctatcccccaggaccctgagtaggaaaaccatctttgattacatccaagtggccaagcggtcccttgtcttgctcttatccatggatggctttcaccgtggatgtccatgtacgaaacttcagtaagatcgaaggcagagttctttgccccttatcaccttgtgtagtctttctgattggtaagacaccctttgaactgtgaacctgctcaaagcccccctgagtgtcattgctgaacccaggcctccaggccaagagctactggggagaggaaccgacaatagagtctcactaggtctgcaccatgatgaatagcgaccaacaattgtgtctgctggcatgaccatgtgtgtaacagtgatggcgaggaactgcagagcctgctcctcattagccttcaataagctgggtggcagccggctatcaccttctcattcatgaagggggtgtgcaacttgagagagttatgttaggcccctctgaatgagtgtctcacaacccctttctttcccgtctcaggatgcggtccacctggagatgctgaaaagattaatgagcaagacataaagacaacagctgccctaagcaacagctgtctcacaccaaccatgagtaattagacaaatgaggcaaagtggatcccaaccagaggggactttggttcacgctgacagtctcccccctctctgggtgtccacccctcctttcctacactcagactgtccctttagctgtctggatgccattgtcccaggtctgttcttggaagtgactgtggtcttgaccctgagggccgagctaggctgtgagtgtggatggcagccctccctcctctcctggaggaacagagcagagggcagggtggaagatgttgccaagaatccaacagtttttgtaacagaagcaagagctcctggcaagaagtccgaggaactttcttgatcataagtggtgtctcttaagctctttaattacagaggattaagcaggaagtggagtgcaggactaaaggaataatggcaaaaggaggcgaagcagaaaaacccaatttcctttctggaaggggggaaatcctccatttatttaagtgacttgcacagagaagagcgatatgtagtgttttcccctagctctaagttcaatggtttggtttttttagaactgtgtatctccttagcaggacataaggcagggtcttcagctcatctgcagaaaagggaccgagtgcttcattaagatgcaggcatatgcttccccttcaaatggctggctgatcccgtgcccgccttccttcttctgcgtgtgagcttctgcctagcctagctcacattttcattcagcaactctagttacctagaaatggctgcaaaattgcaaaacggaaaggcagcgggtcgtgtggctccatcagttctgcctgcagtggcagcacccttgacttgcatggggagaggcactcacagagagcctgggggcccaggtacccctcagaagtcgctgtgtggatggatacctgcttgtagcatactgctgtgtaactgggacaaacctagacatgaatagagttaaaatcaggctgtagagagtaatgaggaacaaggacatgccccagtggcagatatacgatcatagtggcgattgtcctgtatgcagtggatgtgcaactccaaagtgcagtcctggtaagatcctagtcatagcttctacatactaactcgccctacctatagaatctgtcctggggtcctctttgtgcgacatggtatccagaatctgggtcaaggcattctgtagctttatcatcagcatcatcattagaaaagaataatctgtcaaggtccagaggaagacaggtgaagggagcagaaattgagtcctctgtgtactgtgttctatcttcagcagctcacccagcaactcgtacaagtctcataacagtttggtaggcaggcattgttaccatacagatggggagagcgaggctccaagaagcttgaccatggggggtagaagctggagggagaaaacatggagccttaaagataaatttagcccagccctatcgtccacagacttagcagcaaggtccaaagtgtatgtcctagttagtgctaactgtcaaattgactcagcctagaatcacccaaatagaaccttgattgagtaccttcgtagggtttgtctgcaaaggattgtcttattattaattgatgcagaaggtctgagtccaccgtgggtggcaccatcctccagcaagttgtccttggttttataagaaagctagctaagcatgagccaacaagtgattcagaaagtgagtaagcaaacagtggtcctccaaggttcttgcttcattttccccgccttgactccctgcagtgataaactgtgaccagaagttgtaagccaaataaatcctcttctcacctaggttgcttttaggcagaatgtcttattacagcaacagaatgacaccataacacaccagtgtgtgatatccatttcttcctgtaaaatcttgacaagagtgtccatgccctgggtcatcaggggaatgaaataagatcacacagatgatggcacaggcctggcataacatagccagcccctcacctccaaatggcaggaactcttctatggtctcgcataggagaatcacattttgaaacctgaaaggccaaccacaccctaccaccataacagctggcccccaatccacaccggagtatggattataaggagataaataggcagggtatggtattagacatctgatgagcctggtacccttggagtttttcatgattaagctttgtacaatgaagtttagtccccaagcctcggcaaacaggggtggacaggaggatgaccttaacccactgtacatgatacgtattgttctgtgaacatttctatgtgtttgaaatgttttgttaaaacaagtaccaccaggggcttgggggatgattggaatagcaaaaaacttgccatggaagcttgaggaccagagtttcagtccccagcacccaggtaaatttcaagtgggcgtggaagtccacctataatcccagcatatgggaggcagaagtagaagatcctggagtaagtagactagctataccagcctaattgtcaagctctgggttcaaatagaccctccatcaatatttatattatatatgttatattatatatcatagatattatatgtatattatattttatataatatattatatattatatatatatatggaaagtagtcaaggaagagactcagcatcaacctttgaccatgcacacacacacatgtgcaaccacatacacttgtactcacatgtatgggaacccatgtgcacataacaaaattatgactatgccttgccccaagcctgatgggagtttcatcagtactaacagctcgtcagacaaagaggacaggaggtgagaaatcaccctcgggcattcacaacttgccacgttctatcactaaaattttctccctctgcagctctctagcctgccctacgcactatgtgcccttcatgcctagcatagtgctgggcacatagtaagaactcaacaaaagggacagtcacataccggactaaataaacagcatagttaaaaaaaaaatagctgagtcaacaaaacaaaacaaccaaaaaccaaccaaccaaccaaacaaacaaacccagagctgagtccctctcccagagctgagtccctctcccagagctaagcctccgggtctgtgctgctccagcttgatttctgcataccttaagactacaaagcagatggtccatttctgtcctcagtcatggggcggagcagggctggtctcaagcactagagatgcttatgttccctgactccgaaggtggattagagcatatgcccccctgattccaaccaagacacgctttcatccccacaaatgaggcttctccacgctcacgtaatgggatcccaaataacatgatgcaaaccaatcctttatcacacttgccccttggaacgcatttcaaatactggccattaaaaacaggccatttcacagagctttaatgatgacactaataactgtggatttttgtctcccagagccccgatgagccgagctggggagtaaattatgaagctaacttttatgtgcatggtttattgatctttgagcttcaagggaactgcaccagcccctatagcctgacagtccagattagcttttcatctatgtaattgggccaccagggcacagttaatttttaatttatattaataggaagacaaagaacacagtgcgccttctctgcattcaagtaatggacatatcaaaacattctacctggtaattataaataaaccattcttcccatgacccagtgagggttggcttacaggttcgttgtgtatttcaccataatgtatcatgaggaagttccccactgccatgaatatttataccatcacatgcagaaggctactcccatcgttaagtagcccgctctttaatccgtgtttggttttaacaggtgaaagtcatgctgcgtatctgttccacatcagctcgagatacctcagaatccagctctttcctgaaggtggacccacggaagaagcagatcaccttgtatgatcccctgacttgcggaggtcaaaatgccttccagaaaagaagcagccaggttcctccgaagatgtttgccttcgatgctgttttcccacaagatgcttctcaggtgggttagagttccctcggggctcacctaccattgattaagggggtgtgagcctgtagggtttcttctgggacactctaacgaacgagttcctccatccatattattatgtttggaagtcattctgagctccacggaataccccagctcttccaagttactggtatggtagtttccctggaaagttctagtgtggtgggatttcagcaagttatatacttggagggctgaggaggtggctcagttggtgaagtgcttgccacacaaacctgaagatctgagttcatatcctcagccatcatacaagttatgcatggtggtgcacgcttgtaataggctccttggagctcattggctggctagtcttgtctgatggatgcgctccaggatcggtgagcaatcctggaaagagacagagagagacagagaagacagagacagatagatacagatacagacagacagacagacagacagacagagaatgaatgaatgaacccaacatcaatctctagcctccacacttattcagtcatgtgtgaatacccctacacatacagagatatgtatacacacacacacacacacacacacacacaccacatgcttggggagaaatgaaaacaaggcagttattgataagaaactaactggaaaggttggaggttttggggtgactgtaaaaacgtgctgacaactgacctgttaggattctcctcctgactgggctttgggaggccatgtaacagggaaaatatttcaggtaactggattaaagtctcatagccatggggagtgggaggcaggattatagccccagtgaggaaatgatgtgctcagtagggaaagagaggttgaaacacacctgtggccagaaccagtggagaaacgaggaacggaagagtgtgtggtatcagtcagcactcgctgcatgacaagtaaggcctctgacctctcctccataccaaaaataagtgaatatattcatctatggtgaattaagcataccacagacagccagtggcctgctttgcctgcattgtggcatcagggaccctgtgtctttctgataaactttaaggacttcccaagctttatgtaaaacccttcttagtatgtcagttaaggctacagctgaccagaggaccagaggaccagagcaccaacagttagcatctgcagcctgttcgttttctctatgttgtatattgtaggggctattggggttggcatgacgtgtgtcttccaccaacaggccctagcacatgtaggcaccattcgtctggaagctcaacatcactgtcccgaggtttatcctaggaagatgaggccctttgtggttaagattttgcagtttctcttcatttcaatttttatgtcgtaccacccaatgagtttgataatctaaacctgacaccagggctaataaatggcctacagataatttaattaacgggttaaaacttttccaaagctatctgggaagttgaaaggattctaaagcatgccctaaattaagcctggactattaatgagttttagatttattcccgaaaaaaaaaaaagccatttttattgccagtcttttttacacttctcacttggttcccaggctgaagatgctcaaagctgcatggtcacagacctcagaacattctgatttgctccgtgtcttgtggtataaatctctatgtatatctgtggttttcaagaaccttcacctacgtcaagccatggactcccctttgaaatcttttgggtagaaagagacattttaaattcttttcataccccagacaaggacactatgactccacaaataatccttgttaccttagttcctgtcctaagcagatatcttcccccgagcccaccacttcccccttaactgcagtgcatcctgcttcgtacaccatgtctttgacacagcagtatttggtcaactatttcctaaaagtgtgtcattgcgtaagtcatataactctctgggtctccatgtccttatgtggcaaattcatgtgcctcattagactattatgacagcaagtgttcaacagaccttgtctgtctgaagtgtcatgatttttaatatgataccactggtgtagccagcttaaccccacagagtcagcaccccttaagccacaaggcacaaaacaggcaaatgtgcagtgtggctttgactgggtcacctgttcttgtatctgtattgtcctacgatgttggacaggctagcctgggtttgtggacatggcagtgtccagggcatagatatgctggctcagaactgagctgacactatcatttctgctatattctactggcccagattcaagggacactctcaggcccttacctgtgtggcagctgtcactatggtggccccaggaatctgtgaattctttcttcctgcttctaagaacatcatctccctggcactgagtaacaataagaatggccctattccttctttcccttaagagctatccctgttaccctgaagtagccttggcagctttgaccacccactgttgggagaaacgtttgctagatcttgcttaggtgtagatggagaggactgagacctgtggctgagcaaaaccttgggcagagctgtccctgctgtggtcagggaggcttcctgctgcgctgggcccatggggaaggacagcagggagtgtccaggggtcactgtcagcccttagcaaaccacactaggcaaatctccagtcattctcttctccctgaagagcagaagccctacaggggagtgtgtggtgatcctcataccctgtgaggccactcctgtgtcttcactgccccttggtctctttactggtgacaccaatggcagtttgttctgcttataaccaaaattctccttggtgtcttaagactctcttaattaacatcatgtgtggctagggtggctggcagtctcccgacccccacctcatttcaagttgaaggtgggcttgtgggcagtaacttctccctgcactggatgagacagttcaggctaactccagacaacctctactgttctagtctcagcttcagagcaacattggctcttgtcaccttagacctggaagttgtataagatctcatggtcctcacatagtcctatccctccatcccttggctaaaggggacccctgaagagctgctgaggtgactgcccatgaacaattgactattgttgggagtgtggtctttcaatttcagcttggaagagggaaatcgacttccaaatacttagatccattgcacagctgcaccacggagctgaacgactacattcatggcccaggctgcctcctttcagattcccactgggaggcacactgctccaatggctgcagagccctagcatttgatggctctcagggcctctatgagctctgaccccagccctgagacagaagtgaaggcgaagcaaaaggtcatggaaagtacttctgtcctcctgttgctgcagtggcctgagatgctaactagagagtttctggatctctgaggtggtccacacacttgactgcatagctttagtttgcagcttgcactgtcactgagcatcaatggagagatacaaagaagtcatcgagaacctgctctcggtgtaaagattgtgataatcacaccgaagacaagaaggcatgcttagctaaagaataccctaaatgacacactgacatgtggccaactgatgctgtttgcagtgagtgtgtgtatagagaaagagggtttcaaaagtcagatgtgagcaaagaaagaagggatgggaagaaagaagaggcacatctagacattcttgattctgttagtactaagatcgtcctcagggtttctgttctaaattggaaatcatgttttcctctctagtatgactagcttgtttgagagatggtgtgtttgtgtgtgtatgtgtgtgtgtgtgtgtgtgtgtgtgtgtgtaaggttctggtggacagagagacaatagagagtcaagttccttgctgaggaggctgacagaggggacaagggtccagaacccatcccattctctcactgcagcctgtacctactttaagactggagagtgctaaaggaaggtttgtattcagtgtgtttcactgataacatgggtagaaagtccccagtgtttttaagtggcagaggctggaccatctgggactgtggtgatgctaggactccaagccccaggaaggcagagtcacttctatgtcattgaggtgccttaggtgctgcgcggtgcatttatcgagtgccttgtcttgtgtcttccaggctgaagtttgtgctggaactgtggccgaagtcatccagtctgtggtgaacggggcagatggctgtgtgttctgttttggccatgccaagctaggtgagtggaaacttgacttctgtcttgtgctgatcactaggtaacctcattcctgtctcgatattggttctagattcctcgatgcgagggcaggctaagttcccttttggtaccaaactgagtgataaagaacaaccatgcctgactttgaaacaatgtcagtcctaagtggacagacctattcccataagacagcttcaactccaagaggggaataacaggataacgaggtcataggtcaaggtcatagtcaagcccagggagtagagaagcagggaaggtgttcatgtctgtcttgatcatgggatggatgtctgggaagcagattcgggtgggtggagccaatggaggaatctccaagcagagtcccacatgggggaagcaaaccaaagctgtccttgggccaacatccagccctgtgaggagtgctccctgtgaaaagtcctccccgtttcagcacttgagaaagaagccaccaactagcgctgcaaaacattggcttaaatcccctgctacattctctttccagtcctgatctctctgcctcccaggccttgtcagatgtacagaaagagttagcaatttcggaagcttcttggtagaagaaatcatcccagagccttgtagaggacacagagacctctcccctgtgacagagagcccattccaccccacccccactcctttcttcacttcttgatcacagatcaaagcaggggtcccgattttaatggaatttgctcatgctattaaaaacaaaacaaaacaaaaccaaagcaaaccagcatttaacttgagaaaggatataaagcacgcatgtgtggatttaatctgtggggtagctataaaaaggactgtaatcgtgatgaaaagccccagcttcctacttcatgtagaacaagcccaaaggcagatagcctgtttgaggtcctctgcaaggccccttgtgacttcaccctgtcatttgtttgggctctcacattcttttatagctgcttcacctccagtataaggaaatgtttgctacttttccggtcttttcattctttagcttgccctcgtcccactccccacaccttcctcctgtatcctcagcatctgctttttgaagctctaatgagtgatgtctgtgtgtctctcttcccctgctcccacagggaaatcctacaccatgatcggaagggacgactctatgcagaacctgggcattattccatgtgctatttcttggctgttcaagcttatcaatgagcgcaaagagaagacgggggcccgattctcagtccgcatctcagccgttgaggtgtggggaaaagaggagaaccttcgagacctgttgtctgaggtggccacgggcagcctacaggacgggcagtccccaggcgtgtacctctgtgaagaccccatctgtggcacacaggtgactggctgctttggaagtttgacttagctgggggtgactcctctctacttcagaggatggggcatctcagacctggaatcatttaccatgtaaactgggaaatgcttatgagtgtttactttaaagtggacgggaactttatggcctgcagctgtggggccatctgctcacccaacctaaatatttgtaccttgaatctaattgacaatgagcaggaactgcaattgtcatagcattttgggggagattgaatccactttcttgatgcctctttcaagaatgaaaaaaaaaaagtacagtctttcttttgtttaacaacaaactgaaatatttactgctgtgcacaaatagctgcagccattacaggggctgtttatggctctataaactgtgtttctggcactgctttacagccggattagcagtgctgtgggaaaaactagtaaccgatttctaattagaaccgtgatagaattgctagaactatggaagctgagagaagttcttatttgccttttcaggaagtcaggccttttaagggggcagggagtcttccctttgctgtttaacatagggatctctctgtggctctcccggttcatatccggaaagtccgttctgccagtttcctgcagtatgcttcccaaaacgccccatcttagataggagtctctgataaatacctggctcctaccagctaggtcatttctgtgaatgaggatgccccagaaacaatattatacccaactctcaaagcctgaccctgcttagcctctgatcagggaacctggacccttccagtgtcctttagaaatctctgtagtgtgcatcagcgttgtctggaggtcttgttgaaattgagcactgggcttctccctaagagtttctgactccacttgaggtaaagctcactgccctgcaatgtgcattcctaacaagttcccataggatccagggggctgtcactctgagggaagcatagcatctgcttagatgtaggtgcacagactccatgacggaagcagtaggtgcatagactccatgacggaagcagaagcacccgggccactggtccttctgcaaacttggcagggctcaaacatgtgtgaacttgggttcattttggagcctactaccaaaggttctcttaagtaaagatctgtttcccaacggtaaataaggcaaagaaagtaatggcctcttgaaactcttctttaaaatatgtataattctgcagtttaagtctgatagtaagttcaaaaggacacatccgataaaactcccttcaaagttccaggattttaaagctggtgttagtttgcaaatcctgcctgcaccaaatattgcttctcacagtttgaaattataggtatggttaaagtcggagtagaaaattgtcataatttgtaccaacccaaagacatgttgcaaatcagttctttgaaaaatcaaagctaaatcaggctcgcacctgctgtgccagccttcagatcacagaggagaggcgatgcagagtgtgaggagacgcaaggacttgtctcaacaaaaccaaaactagatttccttttccaccacaaaagggaccactgggactcagaccccattctcacaagattcagacacaatgcccactgcgtcttttctaactgtgtgtgagtttgccctgaacataaattcaggaactaaatcaaaaacagatctctctctctctctctcaaatacagatgagacctccaagtacttaaatgtttctacatgacttttgtacattgttctgttgctaggataaaataccccaacataagcaacttgacagtctttattaggacttgaagttgaaggggatagatcattgccaaggcagcaggagcctgtagcatctgatcacgtgacattcacaaccaggaagcaagagtgagggaatgcctgctgctgctgagctctgtctgtccacttgcacagcccaggagcccagccaggggacagtgccaccctctgtgggtgggtcttcccacctcaaccatgcagtcacaataacccaacggtcagatccggaggcctagctcccaagtgattcgaggttctgtcaagttgacagctatcactagacaccatatatgtacttgttgttcacaacaattatgtgactaaatgtggccccaaaccagcttttattaaataaccaagaaattgaaaatgaacactaggcaagttccttccttctccggtgtaaatcacatttcacctgtctccaatacaatctctaaggtcaaaatccagtcacatctctcatgttagaggatggacggtccaggatgttggtttttgagatgagcatgtgctaccaccaacaccctgacacagccctttgctagctgtaaaatatttaaaaccaagttacgtccaataaatgtggacaatcttacttttaaaaaacaaattaactaagctgggttgccttagccattaaagtcctagccacaaaggcatgaggattagagttcagagttccagaacacacataaatgttgggtgggtatgaaggccagactataattctagccttgaaagcagaagttctcaaccttcctaatgctgtgaccttttgatagagttccttgtgttatgaacccaaacataaagttatttcactgctactccataattgtaatttcactactgttatgaatcataagataaatatctgttttctgatggtcttaggtaaaccctccagaaagggtcatttgacaccctcccaggggtcacaacccataggttgagactcactgccctaaagagagccaggatcaacacagcaggcttgctaagaaactcttatatctggaattctgggatcaagtgagagaccctcccataacaaacaatcaaggataattcccagtgttaaccccaggcctctacaggcacacccacacacatgcaaacaagcctacccacatatgcatcctatgcatacatgaaaaatgtatgaaaaaaaatgactaagctgagactggcccatgcgtacaggcctggtttcagaaggacttctgccttccagagtggatggagcccacagcctcatctcttactttctgtcccccagctgcagaaccagagtgagctccgggcccccaccgcagagaaagctgccttcttcctggacgccgccattgcctcgaggcgaagcaaccaacaggattgtgacgaggatgaccaccgcaactcccatatgctcttcaccctgcacatctaccagtaccggatggagaagagcgggaagggtggaagtaagtccatcttagccagctccagcactagcgctggccagccagcacccctcacctaaggccgcagcagcatcctcccttagcagagggtgtggcacctacctgcagctcagtggtctggaattcaaaataattgtagattataggcccaagctcactcttgagttgaacagggacaaaagggtagctttggcaatgataacttataaatggcactgctctggatatgtaaaagaatgggtttaaaaaagaaaagcgcatgttgaacactttagctctgttcgcaagtcctgctgggatctctacctgtattgtcagggagttccagagtaacagagcttatagaatgactctctctatcgctttctacgtgtgtgtgtgttcccacttcaaagattcagattagaagtaaatctttccacttaaaattaagcagaactccctctcagatgtgctttctctgtgggggttttagttcattccagttgtagttaagttcacaaccaagaatagccatcaccccaccccaccaaaaccaagagtaagccactagaggactccccaacatgctattcatcactatgctgagtctgccctataggctaggaagtaataatcgtgtttctgaatagtttataaatcatactttgaaagaacagccagatgtgggctgttcctctctatgtttccgtataaatgctagcacagtgattgctctgtgacagagccacccaaccagaccccagctctgttcacagtcccagccttctacttttcccaaagctaggactgggctagtaaggcagggactctcacgaacatcttggcagggcttttgatgcccaagcaactagcccgcagttcttcttaaatgattgtggatgccaggaaagcaacaaaacctgagtagggagggaaaccctgccttgagaattattagaagaggccctattccaaggaaaatctgaaattaaaacatccacctatgagccatgaacggggggtggggggggtgggcacacatagtttcccctcaagtgtccttgttgcccagaagacttgcacaatgctcctgagatagttctctggggttcctggtatcctcaactggaaaattctctctcccacctcattgcctccattggtctgactcctcctgcacttcctactctctagagtttgtccacttgattccttgtttccacagttgtcttggttttctgaaccaatgtctcactatttagcctgggtatccttgaactggcaatcctcctgtctcaccctccagtgtgccaggcttgcagccatgtacccaccacacctaacttagctacagagtcttagatgcaggtttattgagggaaaatttgtatccagtggcctgcaaagttgtctttgctctttattctcagcccttagcccacctggaatctgtggcaagcactgatctgtttctctctgtgtttgacttaactcagagtagtatgcgactcaatcttgtggcccaatgggtccctttgtgcctgacttctttcatttaactcagtgcacttgagattcgtttctctggctaatatatcacttgttcacttaccttccttattctttgccatcttgttttgattggccctgagagctgcctcccatccccaccaggctaatgaatgaaaacagctatctagtagctgggggttccactagccaaggacacctgcacagaatgggaaagcagatggagcagttccccagaaatctagaaatcctgactgtcacttgtcactctgggagatccccctcctcacctacaccatcaccatgggtgccattattaagtaggaccagatctccctggacggcctgagatggtgagggtttgtctcaggaacagcaagatgtattggatgggaatcttttaaaggacacggattctcaaaggagagatcgtgccatgtcacgtactttcatttagcatcacaatcttgaggctggaaatgggactcaggaccagattaggagctcagacatctgcagctaagctgtgagttcctttcttcctgcagtcctgggagctggctgttaagtcccaccctcctgctttttctgggtaatgtcttagcaagtcgatgtgagaactggaacactgatatcttagtcatttaaacagctgtcaatagtagtctgcagtgagttctgacatggtcagcaaaaggaactcccaatatctctgcctcagacaagggcttccaaaggcaccaagcagagaggtccatacggcccaaagagtcgtacatcaagtggcaactctcttttggtgttttatttatttatttattccttcatcttatttgcatcttagaatctgaaagctgaagcaaacaatgaaaatgcagagagattccaccaaagtgcttcaaatgtaaaaatttgaatttctgactccaccacagcgtaaaagaacattctctaaaactgacgacttgctcccaagttggtcctaccaaatcctgagcacttatcaaatatttaacatctaactcatccttttatttctaagttgtgcatgaaaattgcttttaaataataaattcaggtgaaaggaaaaggcagatgccaccagtggcttccaaacctctcaggtgatgtccggtgttgcagtaaactagatgagagaaagggagggttcaggctgtggagggcaaagggcaaaccactcccacctgctagggccccagcatctcaaaggcaaagattcagacccagcctggagcccagcaggatttccgtggatttatgtggctaacccataatgagaagatttggcatgttgtttaaaatggaaattttgtttacttatatataagttataatccctgtggacttggcagccagaactcaattaagggaaggtttattaattagtcaccctgaggggaagcaggaagcagagctgttaaccaactgggagaggcttagcctgatgatggattcaggggcaatctctgctgcaagaactagatacattgtgtgtgtgtgtgtgtgtgtgtgtgtgtgtgtgtgtgtgtgtgtgtgtgcccaagtcttagacctatctatgcattgtatgtgtgcgcatgcacagagagagagagaaagggaaagagagagagagagagagagagagagagagagagagagagagagagagagagagagaggactaaaaccttctggtcaagatagaaaagaacattctttgttgacatgtcactgttttgtagatagtatcaggttgggcttacaatagctccccaatcccaacacatttgtaatattagcagagctagttctccccactcgtgagtccttactgttaaatctataagggcttgcaggctctgtgtaaattcagcactggggagaggagcaagtgctactcctcataacggataactgtcacttctggtggggactcggtgaagccagttttcgttgttcttttcataagaatggactgtaaaagcattcatttatgggctggtgagatggctcagcaggtaaaagtgcttaccatccaaaccaggtgctctgtgttccatccccagaagttatggtggaagggagaaatgattccacacatggcatagcatgcacatacctgtactcataacacacatcatacatatacatgataataatcgacaatttcaattcatccctttgatgcacaaccttttgaacgtccagtgtccaccaacaactaacactgggagtctgatacgttctcacccagcttccttcttgggagccatcatagtctaggctgtccacagatacaggaatgtgtggccatgcacttgggtggacatctgtgtctgcactcatctgattacaagtctaatctgacaatttccttcatcttggctgtctggtggcagtcaaacactctttacaaaggctgcagagtgacctaaaccagccatgtcctacccagggctgtatagttcaaacagctcgaaggatccctcgatccatgcagcaggtatgctcctaaagtgggtgagcctcgctactgtgcacctcagtgcaggctggtgctgtgggtatgctaaccactcagagaactgacctgagcagagagatgaaggcatactgtgggactctcagctccctagccagagtcagttatgaagtgacaccgcctactctgtgcttgcatttttaatctctcccaccatcagtgtcagagctgcctcacctcaggatggaaggaagggaaagaaacaataagaatgaagagtctcaagtcttcttcctctgtaagagcctgcctgttccttacaacttcccagaatgtcccggctacataagattcttctccatagcagcttctgtcccattcttccttacagttctatctcccatgcctgttgggccccgctaggctatgtatttcctgagaacagaagaccctgatcctcatcttgggcctccgtggtactggcccttgcctgcatgccagcactcagtacctgtgtattatattcaatggaatgtgtgctgtattttaaccccagcttcctctaccatataaaacagctagctttggaaagcaagaccaacttgtttggattttgaattacctgggggattagtaaggcaaacctccaagtatgcaagtaagggctattccagagatgttagaccctgagggctctgacctaatgaatggtttaatgccttcaaatttagagttgactattgagacaggagtggggcctcactggaagaagcagattgctggggatcatgtttcaagggtagagcttagtccttgcctctgtctgtttctttatgcttcccagtggctatgatgtgagcaatctcttctaccacacactcttgtcatggcgttcattcatgcttgcctcatggtggggccaggcaaccatggactgacacttagaacacagagcccaaattcatgattctaccttttgaccatctgactcaaatatctaacccagtgtgcaaaccacccttgggcaggctattgctgtgggtacactaagtatgctgccagaagttggtcagttcacagagaaagtccactggacaggggaaccatatcaaaagatacatgtgagtaacaagtgtgcattcattcatattaatcttggggcacacagaggggatttcccttcgagatgactttttaacttaaggttctaactttcatgagctatacaccaattttaattgcttttactgacatttcctcaaagatattcaagaacttaaaagacccatttgctaccaactttttctagctttctttctttttttttcttccttccttccttccttccttccttccttccttccttccctttccttcctaccttccctttccttccttcttcccttcccttccctcccctcccctcccctcccctccccttcctttcctttcctttctttttctttctttctttctttcttttttttctttttttttttttgtgactctgttttctcacgtacacctgatttaactcttctttaaaaacaacttcctaagccaggcagtggtggcacatacttttaatcccagcacttgggaggcagaggcaggtggatttctgagtttgaggccagcctggtctacagagtgagttccaggacagccagggctatacagagaaatcctttctcaaaaacaaaaccaaacaaaacaaacaaacaacatcttcccaaaacattaagcttaatttatatataaatgttgaaactccatgtaaaatggtgttttattggtttttgtgttgtttgtattttagttgcataataaatgaacgtgtcgaaaactgctgatctcctggtagatagacagcgcatcattttggaaccaaagtgcttaaacaaagcagcctcaagcacttggcaagctgtggtgccagtcagtccatgtcttacagaggcaacggagagtgtgactaatcttcagctgggtgggaagacactggatcctagactgcagcccgtgatagttgtctgagaactttgaagtgaatcctagtgcccgttctgtactccagcccaagcaaatgagaaggcctgggagtggggggcagacagcagaagttctttgcaggtcccaggtgattccagagtgctgccatattggaagtcacatttgtgcaagacacgtagaaggctatgcgtgtctcaagagttcacattgggttcccacctgactcagcattaattttcaataacgtcatgggtgattctttttcagcatggacctcagccctccgatctatcatttcagcccaattaatgtataatgtaggcattaggtgatattagaagaatttagtattccccaggacctagcaggtactcaatatagtgtggtttagaaataggtaagattagtgcattgctcccgtggggaaaataaaatgtgtgggtaatttggtttggtctatctctggactcaaaatataaaaaattcggagccaaaggtgtggctgagttggggcctcgcatgcatgaggaagcctgaagtctgattcccagcatcacataaactgagtgtggtaacacaggcctgttctcccagagacatcaaagggtcagagttgttatccccagcaatataggaagttcaaggccagcctggaatatgcaagatgctctttaaaaaaaattgcagaagacagattggactatgttcatttaactcccacgttcttgatctcaggaatctgaaagacagataaggagccagctcctcgcctgcagtcgttccctcccccttgctcattccttgcagaatgacttgtggtgatgtaagttcctgacgctatcaaacagcctgtgcccactggcttcgcaccctgctagattaagtaccttttgggagagccagattctctgaccacccaaacgccagtgggtagagggcagagagcagcgttttccattgcgtaagggtgcctctcattctgagtcatgctgctaattacaggtattttataaaactcttcaacacaatctaagccaccctttgttctctgtgtcctgtttcactatgtgtgtgtgtattatacattttattccattacatcaaatggactattaagtctggaggtccaaattggtctctgtctctgccctttcatctgggatgtgtgaggaatacctaagcctttcctgcctgcataattgggctgcaaaatagatgatattttgtttaaaaataaccgtttctttaacgcattgccatgagccaatcttgcatgatttgaaatagggtagagaagaaataatatggcccctccgagaaggggttgcccctgggacagttgaaaatgagcaaaatgagcttcattcatgtctacagtgtagagaccaagctagagaagggatcagccacaatgctatgctttccagaatgtccgtggccaacagcatgcaggggaattgaaggctccaaggtgatttcccccaagttcttaccaccatccaatccataccttgccctcaaaagtgatctttgagttcaggtacctagaagtgccacctgaacatcccttacatgaagctaactgatgatgttgggacaggtatggggatatatgcatgtgtgtgcatacacctatgcacaggcatggagaacgtgtctcttgttttcctctattgctctctgccttgagccctggagacaggatttctctgtgtgcctgaaggtcactgtttagtctggctggctggtcagagagcttctggattctacccatctgtgcccccgatcctgccccatggtgctgggcctctgggcttccctagccatgcctgcttcttctgtgactcctgtggattcaaactcaggttctcaggtttgcatagcaagtgttcttagccactgggccaccctcccagctcacatggagggggaaaaatgtatttattttccctttattttgcaatgatgctttttctggatgttgactgctcctttgacagtttttaacctttggaaaaatgtttccgtgctagcatcttgcctctttctaaggagaccttggccaccacacttaccttcgttcctttgtatggaatatgtttttgctccttgggccgattttctcttctgctctgagcaatgtgattatcatttgcttcactggttttgttcgatcttcttgttcctgggtcttgctgggcctttttagatttgtgggttggtgttttccatcatttggggaaagtttgggcagttgtttattgtgtacattctggaaatccaagcaggtgaacctcagacacctgaggtagttctgtagcccttctaatttcctccctccccctccccctccctctcccccctcactttttacttttgttgtttacatttgtatttttctccctattttattttgaagatttatactgatatattatcagatttaccaacctttccttttgctaatgtgtaacctgccatgaactccccaatgtaatcccaactttgttcttaatctcttcaaggttattgcatacgctttgttctaatcgagacagatcttgtcagagggctcaggtggccgtgtctctggactttgacacaggatggcagtaactgctcttcatcaccttctccgggggttctaatagctccgcttttctgcgtttacttcaaagactttttcattgtggggttctgggcttgctccttgttacgctcatttatcgttgcatgtgaacttttagatttcccagtctgactgttgggaacggacattcctggccttacctacgcagccctgtgtgcacctgctgatgagcgtacagctgaagcttccagagactgcaaatccaagagttctttccttcccagtgttctgtcctgcccagggctgctgcctccattctcctagactttggattctgtctctcctgagttcattgggccaatcaggttctatctgggctctttgccccaagcctaggaactcttcgcacagctagatgagacaccaccagtgtttgccttatttgtctcatgtgcctcaagaatagctctcctctgtctaatgcctagtatcttaaaaacagctattttgtacacattctgcttatttttggttgctttggatacaaaatgcaatctgctccctgttgctttattgtagcctgaattgatgggtgaaattcttagcttttctgaactttaattttctcatctacaaggagaggatgatggtgtttaggtgattttgtgtgtgggaactgaataagatagatgtctgtgcacctggcaattggcagacactcagcaaacacttgggtctcccctgcctttgcacctggatctcgcatcttccagatttttcctggagttaccaacctggctagactagataatcactcatgaactgttggggttttgactcagtaagtttcagaactctgtcatccatgcaacagttagctaaaactcttaccttcctacaatgagccatttgatctactggaattgtgcttttatttgtaaaataaatggcagtagatttgagaaggtttgttgtttgtggaagacagaatttaagagccctgatggtatttgaaacctcggcttggcttgtttgtcttatgaaatgtttgtcttttccctttcccatgattctcagagagctgcatgaagaagagaaaatgtgttgcccagaccttacccactctccccttttcttcttgtgtcttcccctgtaccagtgtctggaggtcgaagccgcctgcatctcatcgacctcgggagctgtgtgaaagctctcagcaaaaaccgagaaggaggctcggggctgtgcctctcactgtctgctctgggcaacgtcatcctggctttggtcaacgggagcaagcacatcccatacaagtaagtgactctcctactggacagcaagatggcatgtgggcattgcattgagccgtgaccgagtctctgtcctgagggatgccctgggagaagtgcagctaacggtcagtctggtctgggctatgagttcagtgacagagattagctttagctagtgatcatataatgaatcatcttccaaaagctatgtcacggaggcctatagtcatggtcaccattggcggggtaatgtcagcatcacgtcagtggtctgctccatggtgtggcatgcagtgaccaaagagcagtggagcagccagattaaaaccaccagggtaccactcattagatgtggatgtcagggaaacaacagataacttttagttcaagtatgacacctttattattgcgtggacatcacaggcattctgtgatacatctgatatccctacctcggtgagcttaaaaagcctggggtgggggatggggtattcatgtctagttccatggaaatgtttacccctgtatacaggttccttgccttttgatcattactgctccaggaagatcgagtcagagcttctctcatttctgggacagccctaagctgtcaccagtgcccatgaatgacccaggcttagtcaccctttgcccctcacccccattgcccaacttagctgtgtctcccactagctacaggaacctctactcttcttaaaatgagggttatggctctggctaacaactctgtattttatatgcatcacaggaaaataagatgcagaataggcatgaaaatcttttttttttttctggaatctagaaggctgtcaccaatgacaatggtgaccagttaatgatctggttcacttccatttttatcagatttaagtggaaacagcatttgcctcacacaattgccatgagtaactatgtaggggacattttgtttcaacccataaaaatcctttaaatgcaaattaccactgtgggagaaactggggactcagggatgtcccccgaagtgcctgagattcatggcaaatccttgctttctcctttcttctgatttaaattgataacagacacccagacactgtcccccaccaggaggatcttcagggaattacttggtggttataatccttattgtaccccttcttgaaattggtatcccagccacataaaccccagggtagcattccctgtccttgtaaggaccggttcaaggtgagggtttatgatgttctatgatttctactgtgaaatagctcagaatattgggggcctggcaaagaaaaaggtcatggtggggtagaactaactgtagaggctgaggatcttccaaagacaaaaattctacaggacctggttgacttccagaaaatgagaatcaggtctttgaacgtacaacttccagggccatcgtgtagatacagttcaaaatgccaccttgcagtcactgactaggtagtaagtagatcatgcctggtttattcaaattattgaattgttggtgggagagctgggacatggaagcatatggaagtctttgattaggtaaaggtaacttcctctggttacagttcggttccactgtaaacaaatagggaaaccctgtgagttgtttgtattactagttcaaggtctcttgttaggttaaacatatttataacatcggctagtcctaatggccagccacctgccctcttgggaaagctgacaaactgtagtagaatgtcaccagcccctccggacatcctgcttgattctgagagtccttcctaacatttcggccacacaggtgataagcaaagtgtttgtattgtatgtaaacataagcttaacataaatgttgtgtctgcatgagaccacgtcaaggagtggtcccctgaccctaaaagccattagctgtggacacaagcttccatcagtgaccttggtcctgcctaacaaatcaccaaaagcttgctgggaagcacactgctcagtgtcaacaagcatagtggcctgagcagccatctaatgaccagggaatctgtcctgccatcctttggtcatagtgtccgccatcttgcagaagctctgaaagacttctgttctgacattttcttgtattctcagccacggcatagacttagttagtatttgggtctgtgaatctcaattgcaaactgattgatcagtcgactagaaacaatttttttcagaatacaggaaggtaagacaaagatttactcaaatctgccaggcagttggtgacaagatcaaactgtgtggcttttcccagtttgggagacagttagtcgttgaggtcaagtgtctggctggtctctgctctcatcaagctctgcctgatattggctgcctctacacatcagggtgttcagcccagcaggacggtcgacattcccttcatcagaagacagcactctagagccatgctgtgctgcattatattagcagactaaacctttctgggcagcaagccttatctttgctttggctttcccggcaagggtatgtttcttggctgctggcttcctagtgttctgttcactttcaggggaaaaagcaaacccagaaaaatcaagcttcatatcctttgccctcccccatctctctaaaacacaagactccctcccccctcgctcttcatctgtcaccctagacaactgcttcaaaacagcattactcgtgcttgcttctgggaaattaactagaatgtgctcagaggggatatagcctgtctccatttctcttcatcattgtaccggaccatttgtcatgtgagcaagcctgaaagtgagttgggattcattacccatcctgggtgctcccacaagcaccctcaatgtgctctgaatggttctgactctgcagatgatattgcctctgcagatgacaggcgcaggcgtggagtcagttccccacctcagccattatgcagtacaagctgccttggccaatcccaataccattcatttatcagtcctaaatagtgacaccattcagaaaagcatggctgggcgggggggggggggggggggcacaaggagatcagcaaggacaccagccccctagtcagctcggcaatgacagaaagcacaaattgctcttttcttacttcggggagtctcacacccagggaaatctgtccttgttctgagatttctgacagcacatttgcaaattttctccaaggctcattcgttatagttgtctgctatttctcaccacttcttgcacagcgaggagctaggaatctccacaactgacagaatgcgggggggtggggggggtgagcagaggcattagcaggaattctcatgtcacaaaccagggttctaggggttcactttgggagctggtccccgaggagccactgcaaggatccgtcagggtgaacttggcttcagctaaagtgctctgatatcccagaattctgaggatcacagactttctagagaccctggaattctaactgcagctaagttccctacaagggaacctggtcccttttagatgttgtcatgtgatgggaacaagccctgagaaagcatgttcttcgcacactgatccctcaagccccaaagctcataagttcatttataactgtcactgcatttggagaaaccattactttaataagccacacaatgcaatacgagcaggagttcattacggacttcacaggagccaaaccagcgtacttgtgtttgtgcaaaatgatgaagctttttaattgagaactgaccatgacagagacaagagactttatatatttatatacatctatatacatacatacatatttgtgtatgtatatatgtatatacacacacatatatatacacatacacacatacacacacacacacacacacacacacacacatatggatcagcagctgggaatgtgtgtgaaagcaaggacaacaggctgcttgtttgctggtttgataatgagaaagaggctgagtgttggaacaaccacttgtgtgggcctagacagtcactgtggctcctctctggtcttgtctctgttttgggggagttatattctgtgaggaagcttgtggtaccctaaggtcattgtcctgttgagatggccacttctgcacaggtcagttcttgaaaagctgcttccaaactgtcctgcagtgagttctaggggcttttcaggaaagccctcctaatccctttgctatttaaggactttagtcccaaggcttcacttctatgtgctcattttgccagcagggtgtttgcactctgcttccaaaccacagatatttatttgctatgtctggacgcccatttcgtaaggtcgtggaatatcaccctgtatcaccctaatgtcgtgtctgtttatggtgctgttctctgccagcttgggacatggtgccgcatagccacctgtgatggaagctgtgagctccttctgtgctgtggccggagcacccccatttactcatggtcatcactagcaagtgctgggcacagacacctgtgcttgtttcactttcctctctggtggaatggttccactgctgtgatcataaaaagagaaagaaatataagaatatgctctagcagggtttaggggaaggcggtgcctcggcgggcccatgctaaggcatcccttccccctgagggaccagacacatatagcatagaatagagtttattcaggtcatggggaggggagttaagagaatagtagaggcagagaaaggcagagagaaggagagagtagagaaatagaggctggccatgaccacatggattgagagggggaagggaatggggagcaaggaggagcaagagagtaagagagacaagagaggcaagagagaaaggaggggccaagtagcccctttaatagtgggttaggcctacctggctattgccaagtaactgtagggaggagcatacctggctattgccaggtaactgttggggtggagtccagacagaataccaacattcaccaagcttgaaatgcactggggctagtctcttgtcaaacatcagactataaataagcaagcactccaggtagcatctacttccagaagtccctgtctcaccaaagggccagagcacccgtttgcagcctgtagcggaactcttgcttcctcaggctcaagtaaggtaaggctcaatattattttaaggatttcatggcacctgagcacagcaatcccctcaaaccagcaggcaatgctaaaaccaaatgccagtcagagactcagggggggcggagggttggtgtttcatacacagagaccgtttttcctaaaatgttaacacttctgctcatttgagagacagtggggtgcagatgcctgcagacaccaggtgcagcagcaggtctgccatttgggctgcacagggccaccactgctggcacaggccttaaaagtctcatcactcatcttcccagtgtctgcatagatttgggggttctccattacctcagaactgggaactcactgaagaagtttgggagactggaagggttgtgggaaactggggcacatgttacaaattgctgttagccgtgacatcccatacccctgccatcacacagtcctatttctctggattgaatgtagattacttacaggtaccataaaattaaatagatacttgtcagggaaaaaaatgcaaaagaatatcagttctaagattgactcaagatagcgtgaaattggggagaagctctgtatgaggatccctgtgtatgagagaagcgcacatgtgcatatttaacctcctctaaatgcacattaatgctggattatctcccctgatttacggggagaacatcaatttagaactatttgcacaaactccggataccagtttatagcattccctgtttagaaataaaataaccaaagtctcaggttgccaggcaactggagcagtgataattcttaggattgctgctttaaaaatgttcattttatacattttaatgactgttagggagcaaagagagcgagctcagagcatctctgggacacagaaagaagttcttttttatgagattgttcagtatcccgctctctctctcttattcctccctccttgcctcttccctggccgttggtatttttgtagttcattatagaatttacagagacagttatttttttaccaacccaggcagcaattgtctgttgattaactcctccggcgtgatatgtgcaagtcattaagggagaaatgatgtggtgtggactccgctgggctgcagcctgggttcactcatcatttcttatactctaagtttgatcggtcctctctggtgggcagaatcactcctccccaagtcggaccctcagtatggccagaacatcatagctggtattttcctctgcccactgccgttagccactgttagatagagaagcacagcctcgcgaggactggatagaagccaggagactcctcagtttccctttggcttctgactttatcttagcttaacttctgaacttgccgatggatctctcttccttctagatttgaagtcagctagcagtggactcaagggtggactaggaactgaaaccccaaatcttctcaattccagcagagcagagggggctctccctgctcctccacagaggccccaggactcagactcagatccgcagtgctagatccctttctcagacagccatagtactccagagaggaaggcagggcacagtccaggggaagaaggagacagaaggaccccactgagctgctcatgcctggctccatgtttaccgggctccccctctcatgactagagaagaagaaggaagcacaggatctccctctctcgacctttcaaagggaccagaagctaatttatgaactgctggatcagaggacgaaggagaaaattgtttccagtacttattttctggcttttcggctacacgacaggcagttagcatggcgtataaactagcgctctgtgagggttgcttctcaatgagagcatagagataataccccttactaagctgcccaggctattctaaatactttatggatatctactcgtgacggtgacttgtaaccggcaatcttatggcaaagattgggaaactgaggcacagaaaggttgagttctagttcaagttcacacagctgttacaaatcagaactatgtgtctgtctcccagtgtgttgctactgcctaatatgatgcctagaaggttgtcaatgtccagtgaacacttgtcaatggatatgaagcctccgtggaccatatggtccataaagcctgaatatagaggcttgtgagagtttagactggagaggggccagagagtccagtgtgtaatccaggtggcttccttgacctgtttctatgatgacaaagctgagtgtcttagttagggttttactgctgtgaacagacaccatgacaaaggcaactcatataaggacaacatttaattggggctggcttacaggttcagaggttcagtccattatcttcatccttgaacacagcaacatccaggtaggcatggcacaggaggagctgagagttctacagcttcatctgaaggttgctagcagaatactggcttccaggcagctaggatgagcatcttaaagcccagacccacagtgacacacctactccaaggccatacctacttcaacagggccacaccttctaatagtaccactccttgggccaaacatatgcaaaccatcacactgagactggtggctaggtgccagtggtgaagtggacagtgaaacaaagaagaaaatggaaaagaagtccctcattccagaccaaagtcacaaaccagggctcaatcaaatgtcacatgaaaatgttaagagctgagcttagtaatgcaggcctgtgatcctcattactctggtggtagaggcagggggattgtgagttcaaggctaatctgggcaacttagtgtgcgactctgcctcaaagtaaaaagtaaaaatagtagaggggtgctacacaacttagcagctcaatacttgttcagcccccagtaacaaaacagtgcacgcacacacacacacaaactatgttcagtagggcagaggaaacaggactctgatagcctgcaatggagcccagtggcctgggtgcttcactcagtgctagccatggaggaacttagccaatcacagacatttcacttgtcctgagagtctgtgaagctatctcacatccccatcagcaataaagccacatatccccatggcacctatgccacacagctctcctactttgcctgggagctccagcaagaaaagtgggtctgttccccaaaccagagagctgggtgctgcccacaattgacagataggaccatggttgtgggttttcttccctgggatgccactgtctctgaggtgttgagagagcaggctcctaggcccctataagtagaagaggttatcatctgctgtgtcctgaagtttggcagcatagccgcttagtaatgaagggatacgcacgcaggaggtgcagatggtgccagggttttgctgtgcctgcggtaatgagcttcctcaagcatctagctgagagtggaaacattaggaacttccccagatgagacgatcagtctcacaactggaatttgtcaactttcttcaccctgagctcccaaagaagtgtggtagagcaggacagctgtggtctctaaatgagacaccgccgccgccacctgggctggcagagccacactcaaggtgaggccagggaacagggatgtcagcaccacttttgggactcagggactatttcagcccattttcaaccttgtgatcaggattcattcttgccctccacttctgaaacaaaattagatcccatggacaaaatgtctgggaggccctttgagaacacacatttcaaaggtgagaaggccagggtgtgagtatattctaaacttttttttttattagatattttcttcatttacatttcaaatgctatcccaaaagtcccttataccctcccccctgccctagtccccaacccatccactctggcttcctggccctggcattcccctgtactggggcatatgatctttgcaagaccaagggcctttcctccctttgatggctgactaggccatcctcttctacatatgcaactagagacacaattctggggggtactggttagctcatattgttgatcctcctatagggttgccaacccctttagctccttgggtattttctagctcttctttaggggccctgtgttccatccaatagttgacttaactgggttttcctgcctcccttcaaagcccaaaaccttcacagatgctctgccctctgctgtattgatggagagattggctgttacccattgtgataaactactgagctaaatgtgagactccaaacccacagcttatggttatcttttatgataactaattgtcacgtcacaagccattctgttcattacagaaagcaaacagctgaaggaggatgtcttttggttagtccaggccagtgcacagaggagcccaagatgcccttaggcaccccgagggctctgtggttactcgaggatagcttgatttaggcacaattaggcactggaaaggatggagcatacaaatgagtcaggcttaattcattaaaaaactgccttgaacattaattgagcttcaatcagagtattcaaccataaattctcacctgtttcacaactgattcaggctcaattgagcattaatagattttttttggttcatgcaaatgaggtgataattcattctgttgtgtaattgaataattttcaaatagatttattcacaggaacagttaaattgtgccatgttgtctaatgtcgctcatgatgctttaaccaaagggaagcggggcatcactctggaacaatagagatgtcacgggacagagccggttccggtgaagtcgccgctggtgtaaagagcagcagactttaagacacctggcgatgttcacttggccttttaggaccacgccccagatgctatatgtttttagggtcaatacaaatttgtaggaagtggtttctcagtttggcagccaactgccccgccccccatttgtaagcacacactccctagttttgtgccccaaaacaccagccttcctgagagttcagtctgtcagcctgcttgttgagttccaggccagtgagagactgtcacagaaaaacaaggttgacagtccctgaggaatgacaacagaggttgttctctggcctccacacacatgaactgaaacacatatatacatgatattttaaaatgtgtattccttcccgtggtccccagggcctcctcgggatgccatctctgcttcaaagccttcctgaggtcttctctcccaaaatattgctgcagaacaattctgtttttttgtttgcatcactcagtcccctgtcatatgaactcatcacgataatgacagcctctcccttgggttccatattggtatatactcatttggactgacccaacttgatcttaaagcccgtgtctttagtaacaaatgggaatcgacccaacaaacttgcctccatgatcaaaacagtaccctgtagagctctgtctgatgacctgtcaatcagcaggtcttcccactctgtctgcttaaacatacgttacattcatgctccttggaatatctgactgtatttctatctgtgatctggacggctttttcttgtgtgaagatctagagctcacacaaaaagctccacagtgaatagtgacagtgtcactctaggcagcaagtgcactgtcagaagcatagacacacttgcatcttcccccatggtcagagactagtgggtggcagtaaattcacacactgaaccaatttaattggcttttcttcacttatagtactgagtctacttgattgacctggtcattggcaatcacgggccctcttattccaggcttccttactgagattaactcttgcatcacacactccttttcatacaatagtgtgtgtgtgtgtgtgtgtgtgtgtgtgtgtacacgtgtgagtgtgcatgtgtgagtttatatatatatatatgtgagtgtatatgtgagtgtgtgtatgcatgtgtgtgtattgaatgagtgtgtgaagtatgtgtgagtatgtgtgcagtgagttggtgtgtgtatatgtgtgagcaagtgtgagtgcatggatgagtgtatgtgaatgaatgtgggcatgtgtgtatatgtgagtgagtatgtgagtatgtgtgtgttagactgatgatgaaagggttacagaaatggcagtgttggaggaggtcttactgaaggtaagatctgggagctgatgcaggtgtgaagagggacatcataagtacttagttaaggcagtaaggaccctgttgtcgatttgggtccagaaaaagagacatgcaaggggctgtatcacgtgaggagatatatccaggagactgtcgtgattgctccctgactgtgaactgaatgttctgatgacaagggggtagttcttcatatctcagtgaaggtctctgcatttatacatccacacaaaacccacaactctaagctcagaggtagataagataggaagccagttatgatgaccatggccaaggaacacaggtgtagggctccccaaatgccagcctttcaatgtggaagcagattcatgaagattttatagtaacaggacaaagccataaaacactccctaaacacattggtgggaacagttaataggcagttaaaggaaagttgagaaagcactactggaggccttgatgctgtctggtgactcatacagccttctggttggtgctatctagggttttcttaagctaataccttccaaaagcttcttaactgttagcctcaggatgttaggggcaacacaaaagtaggcaaaggagggctcttcagaggactaaagaaggccggagataaattctgctccggaccggcaacattccaccctcgctacagtcaccgaagatccaatctgttagtgagccttccaggtttcagtgtgaaggtacagcttttctgagagctttcattcatacagacgatcccaggtatcagtgtgtaaccaaccattcattggtctggtgagctctgtaagttcacaggccaggtttcactgtcaggttttgactggcccctgtgtcaacacgtttcctgatttaatttggtaagcccagagatggtggcctctcgactgcttgattagctgagctgtaagcctgtgcaggatacagggtgacgctgttcttatccatgttctcttgactgcatgagctctcaaaatgaacactgcactgtttcgtaaatggagtcactaaggctgaaagccactgccctaggtaataggcagcaacttagaacaactatggctctctgctttctgctgtttaaaagaaaattcaggtgtcctgctcctcaccacccctaattctgacctttgctcctcatccttacgtgtggggatactcccagtctctgatactcctcccttttctcgaaggctggttccctctgcatctcagttacctgttgttattcaatcccaaccccaccctccaattttttcccccttatattttgtctggctgtctggttatttaaagttgaaggctaaacccagatctgttttttaaatagagcccagagcaggaattggtccttcctggtcattttgttgttgtttatttctttgaacatcttaatttccttaaagatgttaatcaactttctgttgtttacttgaaatccatgtgttcatctcaatcggccatctgcggttcctgctggatctatctcctggtgcctcctgtcctcctgtgtttattgttgtctggggactgctcctttgcattggcattttattcctgagacctggataagaagggtttactttacagagtgtttgcatttagttctacgaggtgccagctaaggatagtctaaattgtattctcagcttgaaatattttggaccacccagatcctgagactccagacgatcagcctgcgtgtgattcagactgaagctcaaattcttagagcaatttcctttctgttgttttggtgttttagaggacaagaaaatcatgtcttcaatatgggagaaggacatttgttggagaaggagaatttcctaataaaatgtccatattggactggtctgaggctctgtctttctatttcacaaaccaagcccacctccagcccaggccacatgaaaactaaggcctgtgagatgacctggctggcaaacagcttctgagtgaaagcaagcatcactgttctccttctcgcgagtccccgactttgactagagattgtcttgctcttttgcaagctcaacaatgcatttaatatgaattttacagctatccacactgtgtaattgtgcttggaaaggtcttttggggacatgactagcagactgttctttttccttgttactcacacattctctctcttctgagaagtgagtatctgagcgtagactctggatacccagatgacccacgagacagtccagtctatccctttcagaattgactctgacagcttctcagcctgttgactaagatcacgagcaaactttactctccagcattcttacacaatgaaaactatctctgcacatcaaagataagcagttaaaacttcttgattgcttctctgaatgttaaagagaataaggaaaattgtttcagctatagcttaatgtgctttgctctgcctctgtcttacctgactaggattttgcaatgtctgtgtccctgaaagacccatgtgtgaaaggcttggtcccaggccacagtgctaatggtagcgggacctttaccaggtggaggctagtgggaggaagttaggtcgttggagagtgcacttgagggggatactggggctctgtcttccatcactacctcttgctccctggctcccaaagggtgatcaaccttgcttcctcacacacaaatatttgctcttaccacaggccaacaaggccaatgggctgtggactgaaatctctgaaactgtgagtctaaataaacctttcaaccctttaagttgattacccccgttatttttgttatagtctctgaaatgtaatcatggcagtgctgttttccctaatgctgtatttttcaacagttatcttaagaccaccatggtttttgtgtgataacatataaaattatctgtgtattttgataactgcaactttcctttctcttggcacactagaaatctatgtgtcctacgatctatagtatatttgtttcagtaggatacatttttttcaagtaagaaacaatcaatacatcaattttcagaaaagaaaaaagagcttacagaatttcttgtgtttaatcctttatgtggcttgaactcttgtcctttgtatcccagggtcctctgtttccaggctttgtctttaataattgcaattcattaccagcctcaaaaccggaggattttttctttcaattattgagcacttcattaccaattacaatttagtttgaaaaaaattcaattctaatttagaagacttgtttctaaaactttaacactcagatttgagtcatgaagactgctttgttttgtctactataaagctgcctgctataagcaattttgtgctattccagtttactctttaaagtctcaaatacttttcaagtccaactagtgacaggaagcaaagagagaactgcatgcttcctgaaatttaagatccagccaatcttcctcacatagactttgttgttcagttgcatcctgatggaatctaatgaatttttataacaaaagctcatgtttctctggtagaactgatctcagcacagttattagttgtgtgagtgtatcagctagaaagacagtcaacagaaggtatttctcagtttagcagaactcatcctgtaaagtatggcctcctgttcaccacacaccatgcatatggatagcgagccagaaggtccacccatactacccattctattttggtgaaagtcttgtaatggcaagtgagaagaaatccagactgtaataaacagatgggatacaagataatataaaaccaagacttctgggcatcccaggacatatatagggtccatactatgatcctgtctgtctcatatgaatttgtatttccagggcaggtagagagccaatagtatctcaggttataaatgcatgcttgcagaacaaatgactccaaaactacctgtttgtctaaacaggacattctgtatgccagtgcaagggactaagaacaggacactttggagctttttaacaaggtcttccaaaatcctaccatgggctggagtagttcagcagttaagagtacttgcttgcagctcttccaaaagacctgagttcacttcctagcacccacactggtgaccttcaacctcctttaagtccaactccaggggatttgttaccctcacctggcctgtgtggacactacacactcagcatatactcacatagcaacataaaatagaaaagttttgaaccctaaatcccaccacacaggaggctccctttatatttagctccaagccagaatggtacttgccactctttctgggacacatatttatattgtctatgtctaaggtgttagactatgccaacaagtttgaccagccccttttagccaagacaaactgctacacctcagtaggtcctgtgaacttcatatctggatatctacctaggaatagccaagtgtttataacatgtacacatcacattgtattgatgagctgaccagaaccttgccatcagattaagaccacatagtcggtctattggtttctctttggggacactgttgtgcccactccttaagatgacaccctgcatgtaaatgtccttcctgtaatatgccattgaggactgtgatatgtgtggacccaggcaggccagcttgctctgagactgagagagtcagtctgctcttacacagacagaagagtctgagctttgtaggagcagtactcactggaaccccagttcagttggttttcttatgacactggatccttcagacaacaacagaaaaagttatcttagagtctaagacttagatgttgtggatttatgacgtttcatggggtgaagtcttctcttaatggataagtttagccattagagacttgcttgaatgtttataggaagataactatgttagaccccatgctaggcctggatatggaaagaacagacctttgccctcattctgtaagaagccagcatcttctatggtatttgggacatctgccatcccacagtgtaggctcttcatgatgctacagaaaagcattgacttttaactggaaaaccaaccccctcccaaaacaaaacaaaatcaaaaccaaacccaaccaaacaaaaggacctgaggaaggaaggtgcattgaactcctgttctgtggatccagtcagcaggactttgagaaacttgtccattaaggcttcttcagggaacctgggagtgaggaacagggacggagcccttacttagcacttgcatggctctggattctatgctggactctggaaagaatggaaaggaaagacaagagtatattagaccctgaactcaaatcacatttattctgtattttaaactcaaataactgactttggcaccgtgggtggaacaggaccactgtgcccctgacatagaagcccagcccagatacatatgactactcataacctaatgttaacaaaatataaagcccctgcaatggtagcctgtcttatgaccaagcaaaattagaaccacagggaaatgcactcttataacacaatacattttttttaatgtctcattccttcctgtatccctcattaaagtttctgaggcactctctgaagttattaaactgtgtgaatggtcgcctctgtgttccatctttcctcacacttgtacctgtggtggaaactagtcttcaacccagtttcctttcaattccctccaattactgaggcctgtccttcatagcagcacacttggcccatcatctgagaaccctggcatcttgtttctctaaagcacacaatacccagaagccactgcaacaagcactgccctcgtcacctactgaaatttaaattctaccctgtctcaaaagaaacatagacaggaaagtccatagcatgcatgtatgggaaaatggtctttcacagctcttgggctatgactgggagtggcctctaagtaataaagaccacattgagcaattgtcacttgcacatccttagtcattctaattggcaagcttgttgtagcaaaaaaattggaagggttgtgagccacagatacaaaaaaaaaaaattaagattgtgtctaaaaaaaggtgttatgtaaaaatgaagaatctcctatacatcaaaagataccaccaagagattgaaaacaaccaactattgtatctgttttcagagaaggccaggcatgttgtcgcacacttttaatcccagcactcaggaggcagaagcacatgaatctttatgatttcagtgtcagtctggtctacatagtgagtttcaagccatctatgatttcatagtgggaccctgtttaatatttagaacttttaaagttgtcctacaacacaacaacagaagcacttaaacactggacaaaggactttaacagaagtttctctgtagaagacatgaaaatggccaatgagcacacgaaagcgtacataattgcactggtcaccagagaagtgcaaatgaaccctcaataaaacaccatgtcacagtggatgggaaaaaggtgaaagtcagttttacataagaatgtgagaaagtgatgggctttatggcagcaggatgtcacagctgtcccataaacataatcccaaaccaagtgctacaaaggacactggtcaggagccaggccagagagacaagacaaggctcactccaaccctgaatgtcatacgaactcctgaaagccttccaaggctgaagacatagagaggccatttgtgggcctttggggcttagttcagtggatgagagctttgctagtacccgtgaaaccctgtgttctgtcatgtacacacacacacacacacacacacacacacacacacacacacacacacatatatatatatatatatatatatatatatatatatatatatgcccaggtgcacatatacacacacttacagatacacatatacacatgtacataccaaacatacacacatatgcacgtgcacactcatacaaacacgtgcccacagacacacagacacagagactgggctgagatcttcctgataggatgtgtcactgaccactgacctctctcactgttaatatgtgtcttttttttttttaatagcatagggaaagcccagggatgtgcagcctgatggggcagagtgaagagatctccttggttagtgtgggggggtcagactagggtcaagcatttgcagataaagactcctgggattcttagtcacgtgttctctgctgattatatgtagaaaccagaatgagataagttgactctgaaaactaaaaatagtcatgattctaatctaatgtagccacatgcctagatgccttgactatcctgttcaaccccttttagctctttccaaggaatgtgcaggaaagggactcacatgagtttctggagctacaaagtaaaccagctgccattcatcttgtgcctgggattacttctgtgtgtgtgtgtgtgtgtgtgtgtgtgtgtgtgtgtgtgtgtgtgtgtgtaggggcgggtgctggaggggcgggagcacagaggtcaacattagctgtcctccttaatcactggctagcttatattttgaaacagagtctctcattgaaccaagaggtcattgagtagctacaatggctggccagtgatcccagggacccacctgtttgtgtcaccagtacttaaattgcagatgcataccacagtgcctgatgcttttattggcaggggaggaggaggtgacggggctgagatccaaactcaggtccttgtgtttgcctagcaagctactctgtcaactgtgtcatctccccagccctctaccaaccccacctagctgtgatgccaactctgaaaggggagataacggagtgagatttaaaaaaaaaaaaagaggccttatcaaatgccacatccaatacatgcttcgtacgcatttgctacctgaaaccaatattgaagctcaaaggaaagcaaaagaataaaactattccagacacataagcttataatgaaggatacccaggtgatcatgggacgacaaggcagcaatcaagatggtagggagacctgagaaaagatactgggtgaaatcagatttcactgcatcaaagattccatttgtagtcttatttttctctcttctgaagaattctgtgaaagtccaagggcacagacaggggtgagtagaatcagggaagtgcttctaggttaccatgacaacgcaattcctgactttatttttatgcctcatcagcccataagtccagtttgaatgccatcagaggtctctgacattaagatgaacatgtactcccggcccaagaatgatggaaacttgaaaggaagcaaagtttccaaagagtacagtgacctcatctttactctgaagacgtgtgatagccacactttggcataatggagatggtccctagtcctgccccgtgattaaacagccatagagcattgcagaggctagctcacaagtgtcaggactgtaaaaatggctgtagcaaagctttgatgattaatgataataagacttcttggactcaataagattttaaaggaagtgaaaaactaatgggaaaaatgtcaagacagtagttatatctagctgtggtgggagtattgacattggtgcttttgatctggactgattaacaatctttcatcagaccagtttgtatgcgtgatgcatgctgaaggtcttaatgttgaatcactaagcacaaccttcatagcatcccttactttgttaaaatatgagatttttggcagttcacagactcaagggacagctgtatatatgccttttattctattggtctactaatttgttctcttggctgtcttttttttttttttgagggctctttttctttaatgtgatgacaatcctagttcctggttatgctgaagtgaatattaatgaatgtagtcttttctgttcttccctaaagctgttaagtcatatgtattggctggataaatacaggctaaacacagttcccattgtgaaggttcttacagtcttgttagaagagctgagagaagcctgagagagtttttaaggtttgagggcacagtctccaggatgctgttctgcccaagatttctggttatttgggttcaaggatataggagatttagaagagtctgcaccatacttctggtgccaactctgtggttagcaggtaccccaaaacaccatcattcagtagaaggacttacagaacacagtaaaagtatccatgaactgctagactgcatgaaggggccggttctgcatgaccaaagttgcaggatctgcacaacacaggtttttgttgttgttgttgttgttgtttctaagacagggtttctctgtgtagtcatggctgtcctggaactcactttgtagaccaggctggcctcgaactcagaaatccacctgcctctgcctcccaagtgctgggattaaaggcgtgcaggatatcctagagaagttctagtgaggatccaatattgatggtgtagcagaagccagaggccttgaaccagaccaaggactcattgcaatgaacatttgcaagtaaagaagtggggacagaagggtgcactgtgtgacacactgtgacacactatagcttccatggagaaatgtttgttttttgtttgttttattttaaaattttccttatttttattttttgttttcattggtgggggggggggctgcaagggaggagggtagcaatgaaaggacagggagatgcatgggcttgggtgcatggtgtgaaattcacaaagaatctataaaaaggttttttaaagtgcttatcacatgaaaaggctgtggcctctaatcaaccctccgaggagatatgtgagtgaagtagggtctaggaaggttctagtaactgctggacatgtcactgtcccaacatgtgcatgtgaaatatgcactgaaccagcagtgttggcatgaactatgacatctacaactattactgtggctagatagagcagcttcccatatggttgaccccagtcccagagcaatgatacctcatggcccaaagccatgatcttaaaccttgtagttgatcaggttcatgttacccaaaaatctgatgtgaacaccctccattctaaacaaaaatgggtcttaatggctatcacagggtttatctcccaaagctcacagcaaaggggagctcttgtgagaggcgaagctgaattatttgctacataagtgtatgcagacaataaatttatcagagatcataaattgggtgactggggagcaggggatatggctcagtcaataaagagtttgttgcaaaggcatgaagacctgagttcagatcctcagcccccatgtggcccagcagcatacatctggacccatcactcccaggatgaagggagtagcgagacacagatcctggccatcactggccatctaggagagataagtcagtgagattcaggttttagcaagagaccctgtccccaaaataaggtggagaattgaggaaatcaccttacacattcagtgcacatgtataaacatacacgcacatgcacacacctgcacacacacacacaggaacaggcacataccagctcacacacacacagtcacacaaagatatacatatgcatgcacacacacatagatatacacacagtcacacacatacacacagtcacactcacacacactcacataaacatacacacacaatcacacacagacatgcacacatgtgtacacacacatagtcacacagtcacacatagacatacacacacatgcacatatgtgcatacacacagtctcacacacacacacacacacacacacacaaacacacacagttgcatgatagggaagggcttattgtgagcttcagtgaccagccaaacatttgaaagagcaacagaaagaaaactgagtgtgcttaagcaacagaaccctcaggaaagacataagtgtgtctaaaaatgtgagcaatgggcttgtttttaccctgtatgagcccagaggacagagctagtgaccttcacttgatgttgtgaagactgaagtcaaacataaggaaaagacttctaataaggctatctgaaaaatatacagactgcactgcaaagatagtaagccccaccccccagttgaaaatcatcgctacacaaagcatggcatccaaaaccatggcgatccttttcttaggaaatgcaaagacctccctccaagaatccttttgactctatttctttatgcttatatcaatatgttttccatcttgacccatggttgtattctggagttggtaaactatttacgttctgtttctgagtctatggattgtctttcaaatttctgaggtagtacctgggtgccagggctgtggagtgagtgatactctgagcagactgtagatatatgatatctagagtaatttagattctacctcctggcaatcacagagtaccatcttatcttacagctatgagaaggaatgggatattaaataagtagagaacggaaggttcctgtggaatatgagcagtttgctgagcaactccatgcttggtagacatgctagttggtataagtgcagggcccgttctctcaagttctatagccagtgagaggcagggctagctctcctgtgctcatgactttggggccagctttccacactgccataggtgttggggaacatcactcctggatcctctccatctcatggtagatgagggccagctcatctgcaccctctccacccaaggccagctctactgtgaggcctgggtgaggtgcaagacccgctttctcaagtactggagcaggcgaggggcagggatagtaatcctgctcccatgaccctggggcagctctcccaactgccaaaggtgacaaggggcaagggcatcacctctgcacccacaccactcacagcaggtgaggcagggtctgctctcccacactcaagcccccagggactgctcaccaataccttggcctaagggtcagctccactgctttgccagggatgctctcccgagtgcagccatcaatgtcaccagttaaaggtgtgtccagtccctaggagtttttataactaaaaaaagttatgttggattttataggatgggtttttcttgtctaattaggagaatggcgataatttcctactttggtctattaatggactatctcattgattgacttgcataagtcaaagcagctttgcatgccagagacaaatctctcttgatcataatgtataaaatttgcactgaattcaacttactaatgtctcatcaaagggttttacatcactatttatcagagatgatagctatagctttccttagtgtttttgcctggtttaaagtaacaactgttaatatgcataagatagatcttccttgcaacttaaattttgaaaacgctgaagaggtattagcattattttctctttgaaatcttagagtttagctatgaagccacccagtcctgggtcttcctttgttaagagactttaactactattttaatctccttttttcttgttttccttctcctctctctacaatataattgagggttttctgcatttgtttatagatgttaacacaatatattttttatcctgtaacctttctagtctctaacttatttctgccccaaagtttactctttccttcttccctgaacccccaccccaactatggagttttcccctcttcttcttccttgaggtgccatgtcaagctggtgctgggggcagagatctgggggcagggttgtccattgctgtaagaagggctcttggtgttgctttcatgggaatcctgtgtgtgaaggtttttcactattcccactttctagatatttttctgtcttccatttcatttaatttggccccttagttgtttgggcacatattaatctccacaaatttgcttgtgtgttgttattttccctaaaatgaggagtcacagtatcaggtctgatatgacctgtaagtggttgcaatggcttgaggttccagactgggggtgttcggaggcctgtaaagccacagctctgaactcagggtcccacaaacctataataataactgggacttggagcatggcttactctctgaggcctagttagatgcacactgtccacaaagctggctgatgattccaaagcacacccagcagcttcgacctagagcgctgggctgctgtcatgatgctgatcgggctaggatgcacagtgtacagcagtggccctgggctggggtgcacagcatacagcagtggccctgggctggggtgcacagtgtacagcagtggccctgggctggggtgcacagtgtacagcagtggccctgggctaggatgcacagtgtacaacagtggccctgggctggggtgcacagcatacagcagtagccctgggctggggtgttcagcgtacaatagtggcctgattccaggcacagatctaatttgggatccaaagtcaatactgcacagtagcatctcagacccaggatgagaccacattgtcgtatcactaaaccctggaatgatggtgcactgactgcaccccagcaagcacagagctgtggcttgaagttcaagagtcaacaatcaggacaacagtgactccaccatccagcatggtagagtggctttgacagctcacacttcagggttctgattagttccagggaagctgggtgctacacctgtttggccttgagggaaggagctctggatggggctcacagtgctgacttcctctctgaagtagctcagtagtgttgctggaatttttaaccctaataagcccatataaaagacacacaacccagatattttaattataagccatatgcctagattgggcagatctagggctatgctaacttattccacagttataagaccccttgatatttgtggtttctcctgatcatgatattctggtctatcgtggcttctcctcctcttcctccgtcctctctccttccctcttaccctgccacccctctctaccctccagtcccacctttcccctccactgctcagtctcaggggaaaaggttggtatggcatcacctgtgtacctgatggtctgctggttggaggcaacctttcttgaggaaccagtattaacattaggatacaaacagcatcaggccaacccactacacagtagtttagcagggggaccccacttatggcttagtgcctataaggaccacagggctcttcttcaggtgagcaagttggtaactgttgtggccagggtccttctaactaccttccccacaggaaggagtgcctgcccctatgtctaagctgatctcaactagagtcctaggcagggatgctgaggccagacatgcgcttccccttactacagggttgccctgaatgtctgtgctctggaacactcatttggtttagttagttagtttatttttaaatcaaaatatagttgtctacttgtgactttggctgtctttcagcgttcctgtggtagggttacttagtcagccatcttgctcacacagttgctgttaccttttactgatggctatcatgttggagttgtacagggcaatttccctgctcaaatcccaggctccttcagagtagcccatcagttgctcttacctgtgtcagccagcgctacacaaatgttccttaaatgagcagctgtgctccctaatgagctaattagctcagtggacacggacagccaagcagctcctttgcgagggcagaccacttctgtatgtggccggaagtggtgtgagctgtggctgtggtcagggcctggtgctccagtgatttctaaagccaagtattttctctctttgccagtttctgtgcgattgactttgtttcataacatctaaaaagattcaggagccccatagacagctatccatcaaatacagattatagaatattatagaaaccagggcatattcagtggtatcttagttagggtttgactgctgtgagcagacaccatgaccaaggtgagtcttataaaggacaatatttaattggggctggcttacaggttcagaggttcagtccattatcatcaaggtgggagtatggtgacatccaggaaggcatggtgcaggaggagctgagagttttctacattttgatccaaacaagactgctttatcttagtcatttcaataagtatacatggccgggataggcaggagctggaccatgtgttcataaaagatgctacatggatgagtgatatggtttcctctcaggtatgctcagttctgcctcattgcctgcccttcctgctgctaactaacaagtcctccagagccagaggaccttgcatcttcactctctctagctagcctgatcctggggccatggcagagggtcttcatgcctctcttcctgcatcctcagtattgatttggtggtgacgaccatcctaaaatctctttggaaccttgagttgccttcagaatgctcagcgcagcctgcagccgatagcctttgctacctttctctcaccggccttctcggtcatttttgtgtagagtcaaaacatcaccatgaggctgaaaaaaccacagcttcctaagcttttctgcctcactcgagacctgcgattagagacctgtgtccatctggctggcgactctgccgactttctttccacgagactgcagaaaacatcagttgccaagcaacacacacgtcgtggcttcttccagccgtatgcactccctttctaaaagccacaaatatttgtctacaactgtgtcacacatgtggacggtggggagcataccagacagcagactggtggaatgttgtatcattgtcatttggtctgggatcttttcctgaagacttacacagagtcacacggagagccgggagtgtgtgcctttggccgtgggcatcgattagcaagacttcccacaaggaactttatggtcgagtcagctggaggaggcagatttgcagatcccagtgttgtacatttcctgctagataaaatttctttgtaatctccaagccaatattcctgatgcttttatggtgatttaaggacagtgcacagagtggaggaaatttttgagtccctgacacacatgtcccccgctgaagtgtgacaggttgagcactgcctcacgtgctctcggcttcagtgcttttgaattttttatgctttctgcccatgatttcactgtttgaaacgattccccggcatggtacggaagtgctttctagtgagaagaggcacaaaggggcagctctgtgcctcatagagaaaacatgagagttagctaagcttcgttcaggagtgagctcatgggctactggctgcaggttcaatgccgatgtagccattgcatgatacacccacaggggaggaggatttgcctacagtaagcgaggccactcccgaaatggggaaggtcgcatctagagatgagcaaactgaatatgaagactcatcagctgctgcacaatcaaagaagaaagtgatgaactgtgccactctgagacttaaggtcagaggcctctactgtcctatctctcaagaccgggaaaccattgtacactcttggcagtattttatcataaagaaatatgatataaacatcattttttaaaaatcccagatgactttgaatagaaaagtcacctaaaacagggtaccctattgacatttgaccaaactgtcattttcccagaaaggttcacaggaattctaactttgtgtttccctctgccagccatgcctcaggatcccataaattgctgtttatgggtactttatagtgtataactatcatgaattataagagttaactgcatatggtcatagcctaatccaaacagaatccatcttctacttcctgtggttcactcagataaactatctttgctaagtcaagactggcccccaacccccttcctgagacatccctgcagagtatactttgaggggagttaaatgtgatcagatacccccacacttcctcccttttcttttaccacttctatctcctgattcttttgccctggtatatttacaatttgctctgaaactggaacacactagcccatcattcccaaatgagcaccttaattggtcccaggtaggggaaaaaaaaaaaaaacccaccatctttcttccccgaagccagacataagtcacatgagaaaaaaaaaatctctgctggcagtgaccaggatctcacatgaagtctgttgagctgatggtccctctccaggggattctgtagggacttggacttgagaaggacattctgagattgaaacacatcatctgaacatgaaatgtagccagaggttctcccagcctcaggtggggtgctccagggaggagacatatttcacccagcaggtgcctgcatggggagaattcgaggagcagaacccttaaaaaaacatggcaggatctcattagagcaaggacagaacaaggactatgagccattccttcaggtcaattctcaaagagcctagaaaccatcagaggtgccctgggccttattatcactaaccaggatagtggttccacatagcaactgcaaagttcccaggggtagcctttctggaaagttctgcttcctgttgctaagtgactatttgggccgtgtctttctctgcttatcagtaataccaacgtcttttccttcagtgttacaggctgcaatggcagggttgagagacaatggcagtagcatgcctctgtgctataagggggatttcccatgtgttgtaaacacgtgggacttcagtgcaggttcacagcatgctgtctctattacagggattgccctgtgtgcagaaactcgctgagaagggctatgtgtgcagatagcatgccagattgctggtcacaaagccattttcttctgatcccctctccttgtttctattcccaggcctcattatgtgctatgtcatatgcacacaaacagatacactagaatagcccatcgcggccaggacagaagtgccaagggaggtgtttgcatgaatcccatccttggagttagaagcacttgctcagctgccaactgcaaatagccccatgctgcaaagcaatgctaattagtatgccattaaaaaaaaaaaaaaaaaaaaaagaggaagaaaacaccacccacaaccaaatagccacatgcaaacctgaagtcctgccctgacagccagcatgaggcatggcccactaatgcagccttaatccactttgtttggcagggagagcaagctcaccatgcttctgagggagtctctggggaatgtgaactgtcgcaccaccatgatcgcacacatctcggccgcagccagcagctacgcggagaccctgtccaccatccagatcgcgtcgagagtcttaaggatgaagaagaagaagaccaaggtaagggctcttaatgggagggagaatacactggggacaagagccaaatcacaaagagccaatcagtctcgccattctctgaacaccaaggactgtgcaaacgtggctgctgcagcccctgtctcagaacaggaaagccttccaacaacacgggagaaagttgagtgtccttttcatggttgatgctgtcacgggtcacccaccctgaccgctgacagagaccactttagtagattgccgctataagatgaaaaatgtcccaggggtgggaaggaatcaggctcctccacggtcacagaggtgaggtgtgcagccagcaatctggctccagaaaggatggctaatacctcacccctccccgccatgcggttctgccacccctgcatgcccaggagcctgcagccggtgggttcttgtgtcagtgtccttgtgtctgcattgtgttggcagatgtcagtaggctgacttccttgggcagaagcaaagccagggtcgcagtcaaatggcatcagtgtttgagaaaatcacatttctgagccaactcaatacttgagacttccctttcttcctcctttgtatacgccttttatgtatataaaaaggcaaggcttcatgaccagtgttctgaggcaggggaatagtcttgaggaagtcaggtgggatctggataggtcgctacctttcccaagcagactgatacattagtgtgcaaatgggaattatcatacccagggaataggacaggaaggtattctggcatagtccagtgagtgccagcccctctgcaggctggtcttcaagaccctagcgccagtcagcagcttgggcctgcagtatgacacaggcttcctaggagggaaggctatctcaaaaggactccccattaacaattctctcgtccacgttgcagtacacatcaagctcctctgggggagaaagctcctgtgaggaaggcagaatgcgcaggcccacccagctgagacccttccatgcccgggctccggtggatccagaattcccccttgccccactgtccagtgatcctgactactcctccagcagtgagcagtcctgcgacaccgtcatctacatcgggcccaatggcacagccctgtctgacaaggaactcactgacaatgaggggcccccagactttgtgcccattgtgccagccctacagaagaccagaggtgacagccggccgggggaggcagcagaggctgcagccagcaagtcagaaagggactgtctgaagtgcaatacgtttgctgagctgcaggaaagactagattgcatagatggcagcgaagaacccagtaagtttcccttcgaagagctgcccatccagttcgggccggagcaagctggcagatgtgctcctttaagccaagcagtggggccagacacaccctctgagtctgaaaaggaagataacggctcagacaatggccaattgaccgagagggaaggcacagagcttccagcctccaaggcacagcggaatcggtcccctgcccctactgtgacacgcagcagcagccccagtccagcctcaccacggagcatcccgggcagcagtagccagcacagtacctcccagctcacacagagccccagtctccagagcagccgggagagtctgaactcatgtggcttcgtggagggcaagcccagacccatgggctccccgaggctaggcattgccagtctgtccaagacctcagagtacaaacctcccagttctccctctcagaggtgcaaagtctacacccagaagggggtcctgccctcctctgccccaccaccttccctgagcaaggactctggcatggtctccagtgaatccttgcttcagcccgacgtgcgcactcccccagttggaatgagtccccaggttttgaagaaatccatgtctgccgggagcgaagggtttcccggaactctagttgacggtgaggaccaggaaggccctccagcggactctaagaaggagattctgagcaccacaatggtgactgtgcaacagcccctggagctgaatggtgaggatgagttggtcttcacactggtggaggagctgaccatcagcggggtgctcgacagtggacgccctaccagcatcatcagcttcaacagtgactgctccgtgcaggccctggcctcaggctcccggcccgtcagcatcatcagcagcatcagcgaggatctggagtgctactccagcatggcccccgtctccgaggtgagcatcacgcagttcctgcctctcccaaagctgggcctggatgagaaggctcgggacgcgggcagccggcgttcctccatcagctcctggctgagcgagatgagcgcgggcagtgatggcgagcagtcatgccacagcttcatagcccagacgtgctttgggcatggggaagccatggcagaacccccagcctcggagtttgtcagcagcatccagaacacggcagtggtgtgcagagagaagcccgaggtgggccctgacaacctgctcatcttatctgagatgggggaagagtctggcaacaaagccgctcccatcaaaggctgcaaaatctcaacggtgggcaaggccatggtcaccatctccaacacagccagcctgagcagctgcgaagggtacatccccatgaagaccaacatcaccgtttacccctgcatcgccatgagcccccgaaacgtgcaagagcctgagtcctccactgccaccccaaaggtgagccccaaagcatcccaggcccaggaaagcaaggaacccagtacaaggagagagatgaaatttgaggatccttggcttaaacgagaagaagaggtgaaaagggagaacgcttactccagcgaggaaggggttaagtgtgagccgctcccaagctccctgaagactgaaggtaagtcagagcaggaactggatggcaggcccagctcaggcaacaggctgagcagcagcagctcagaggcagccgcctttcaagggactgataacgttaggagagtcgtggatggctgtgagatggccctgcctggcttggtggcccaaagtcccctccatgtcaaccgaaacctaaagtcaagcagcctcccaagggcatttcagaaagctgacaggcacgaggagctggacagcttctaccattgcctggcagacagcaatggcttcagtgctgcttcgggcatcccatcctcgaagacaaccctagagaggaaagttgcttcacccaagcattgcgtcctggcaaggcccaaagggaccccgcctctgcctcctgtccgcaagtctagcttggaccagaagaacagggccagccctcaacacggtggtggcagcagcaacaccagcagccccctgaaccagccagctaccttcttggcttgcttccctgatgagtccaacggcaagactaaggatgtcagtagcagcagtaagctcttcagcgccaagctggaacagctggccagcagaagcaactctcttggcaggacaacagtcagccactacgaatgcttgtcgttggagagggccgaaagcctgtcgtcggtgagctcccgcatgcatgccggcaaagatagtaccatgccccgcactgggaggagcctgggtcgcagcactggcgcctcaccacccagctgtggcatcactcagtccacaggggcctctcccaaggccagccagtctaagatctctgcagtgagcaagctcctgctggccagtcctaaatcccgcagcagcctgtccacctccaccaccaaaaccctcagcttctccaccaagtccctgccacagtctgtgggccagagctccaacctaccgcccagcgggaaacacatgtcctggtccacccagtcgctcagcaggaaccggggctctgggctggcttccaaactgccgctaagagcggtcaacgggcgcatttcggagctgctccagggcagtgcgggcccgaggagtgcacagctgcgggcagaggcggaagagcgcagtggggctccctcggaggacaagcccgcagccgcccacctgctgccctcgccctacagcaagatcacccctccgaggaagccgcaccgctgcagcagcgggcacggtagtgataacagcagtgtcctgagtggggagctaccacctgccatggggaagactgccctcttctaccacagcggaggcagcagtggctacgagagcatgatgagagacagcgaggccaccggcagtgcatcctcagcccaggactccatgagcgagaacagcagctccgtgggagggagatgcaggagcctcaaaaaccaaaagaaaaggtccaattcaggtgggtacctggcatggcttgggggggacagaggcatcaggcttctggaccctcacctcccctgttctcgaccagccatgggggaggggttggtctagatactagatctggggtcttgtgctcactttcctcagtgtcctgataccagagaccttggctgaggacgtaacccccagagactttctactcgatgccaggagatactcgctgtggaggtgccaggcagaaagctggtccttgcttcctccatttacccttatctctgccttcacgctgccattcaaaggctgagtctcccaacccttctgacctagtagctacagacgcctatatatggagctggtggcctccaagaccctggaaactgccctcagggacatagggcactttgtctcatcgaaagtgggatgggagatagcctttctccattcctaccccaaacacattggtgacagttatagacacacctgcagtgggtcctgcagtgcctctccccaagtgttaggcaatatatgccatgcaccatgctgcctacctgtgtgtagggggacttggccatctccagaaatatggggtcagaaggtacatatgcccaacacctcatgcctgagctactaatatatcccttggaatttggggtaggcatgtgatagtaagttatgttgggcaaaaagaagaccaaggtcagagagggtggcccggataccatggagcaggcgaatttaaaagacagagagaagaaagtgggtagagacagaggcatgggtactaagaataatatagatgccatgagaattttatctgaaatgtcatttttcattagatactaaagaaagggtccctataagttctttagtgcaagaacttttgattttttttcttaataaaatcaaatcaattgccctgtgtacacttctgcactcctttgagtgagggcagcagaacagaatgccctgctggcctggccttgcctggatatctaccatcttccatacacagccaggctctgcaattgagagctctgaatcctttaccctgcatgtcaatgccatcagcctagtcaggatcaagagatggggtgacatgcagaaacgggtccctctcccccagcagctgctacaggaaccatccttgggcctttacaacctgccgtggggttgcttttgcctgtttcctgccagatgtgacacacacacacacacacacacacacatggagctctgcaatggaccagcccacataagggctgagagcaatgtccatcataaaccatttgtcttccttggatcaaagaattcaatctccggggactacctaagcttgtggtttcccatccccatctgccgtgatataagaggtccatccatctgtgcggtgctctgcagatcacagcacaaggcttcagcgaggacactccattccgggcaagctcagggactgttgtggctactgccacactggcatctgcacttcctagctgtgcatttctaatctgtcttatttcatccctgtcttggaacaggcttttcagaagacacacacctcctgccccagcccctagaaggaggtaaaagtgacaagctgctgagtgtgtcagggcaggcactgtgacctatcccccaggccaggggccctgaaatgtactgatgttagttactgaaaataactaaataccttatgtataccagccttcatggaaaataactgtgctggccttcctagtacttgattgacaggcattgtcattactgtctactccgtgttggtcttcaaagcccggagaacagtatagcatttgcttcaaggctcgctcacgctttcctggtggagcgagcttctgttttctaatttaatgtgtcgctacccagctactttattcttccaccgtcttcaactttctagtcaaggctccttaatgtgtcggtttggagtgaagcagggaagccacggaatggatggggagagagaacaacagtgtggagaatgacagacagctcggagagaggtagcaggctccacacatgtccttgctcagggctgactccagtcataactgctgccctctgagggactcctcttagaaggctattgaaggaaaatggtgtgtcataaaaatgccagggaaggtgctggagacgggatttaatatggagtgtcccgagcatcagacctctgtgcgcagccaccgcagccaccatagaccgagggctctgtgatagataccgcagggaagacttgctcatttcaggttaggtgaccttgtctgccttatttatgattattattaagagaaatgctggccgtcagacgtgatcaacataaatcacaaacaacttctttaaaagaagccataaggcttcctcaaaggaatttcctacctagccggccagtcctcagtcacaggagacgtctgggatttagaactgcagggtaggcagttatgtttcatctgtgattgttttgcgtttggagaattgtaatgatttagttgctttctgactgaaaaagaattataattgtgtcactgggaaatagccatgagctctcagattctgtgtgatgcatatgtaacagcagagatgatcacacatctggatgtcgccaccatacaagccactgcctatagctccacgttgttgaatgagcctgggcttactgcatgctatagtggaaagattaagcttggggtcatgagctatttgactttaattagcctttctgagcctcaattttcttatgtatgggagtttgatagataatggccagggtccttctgctgggcacattattattatgaaaccaaaagtaatcgtatgacatcctttccatagggaaaccccgtgtgaatgaactttattgtaggttgttgtattagtcaattttttattactataaaaggatgcctgagatgatcaacttagaaaggagtaaggtgctaggtggtggtggcacaggtctttaaccccagcactggggaggcagaggcaggtggagcactgagttcaagcttagcctggtctatagagctagtttcaggacagccagggctacacggagaaaccctgtctcaaaaaaacaaacaaggaggaggaagaggaggaggaggaggaggaggagatggaggaagcagaagcaggagaaggagagggagaaggaagaagaaaggctttagctcctgggctcagtcatggccagttgaccttgttgctttggggccagtagtgaggcagcacacccagcaaggcatgcgtagtagagcaatgatgattgggagtggaaagagggaataaagctagattctcatagttccattcaaagtcatgggcccagtgacccagacctcccactatgtcccaccacccaaaggttccaccacttcccaccagtgtcactctgcagaccacacctttaaaacattgataaaacacccataatcaaaactgcagcaagtgttggccattgatcaggcatccccatacttatggtaggaggggcagcatcacagagtttaagacaaccatgagaagtgtgaaatgtccagagagaggacaatgaacagagacatactgccatgtggctgagcccataatgcagccagcagaaggatgcttttgccataggcaaagtcctgcaaatcaaggcaactgcagaaggctgttggggaaaggcctggtcctgaaggatgctgctgctcatacgggctttggaggctgagaaaataaatcatgggagcccaggtttggagcagcaagagcatggcctatcttgggtttattcaaagtagggttcattcatattggggttcattcagagggaatgttcaaggagcacagtgagagcatagaaaatgtaaagccgggtgatgttatcccttgagcatgtgggaaatgtaacaagaacacacagatgcattctatataccgagagcacatgatatagcggagtcagcaatggagtcattacagactctcaagaggaacttctgtgagtagattttcattgattctctacagttcctagccagccctctgtggtaggcagcacaaaactgtgcagcctagagctctgagttagagtgatgataacctggctgggtggggagtagtgtctgcccagccagtaggcatctaagttgctaagagaatataaatcatcactgcaccaaccaagcccccatgtttaaccctgccacatccctctgaagtcctttttatctcactatctgatcccttgcattgtactgtgggttacccttgcaccttcttgcccttgcttgccgtctctttgtttgatggggaagtctgagaattgacagggaccttgctctgaaggtagttcattcccattgcagggggtttggctagctgctaccagcatctgggaaacttgggctagagggagaggctgcctgaagagaagccacgttggttataagctacactcatgccagggccagcctagccatagatttctgcaatacctgcttggtatctagtactgataaggtacagagtgccactaggtatcactgattgattctttgattggtaattggtggctggcagtatagcctgaaaatgtgtctcctgtttcttatcgagagctttagcatattttgtcctattggtgataagtgttttaaatatagttttaagtgtattctagtctgctggtttttggttgtctgttggttggttttgtttttattgtgtaccaaacactatccttccttctcttactgttgaataaacattgacattggataggccagcccaataggctgccattggctgcctgtcgtgaattataccccatttctcagcactatacaggtgtctgtgactaaggaccctcaatgaactggaagtgccccagactggctctgatgatgatctgattctcaggggtgtggcctgattttgttgtaatgagatcaagaatcatagtggctgtttctaggaaacaggggaagggagctggaggttgccagagtgcttctaagagactcaacctagatatagagagaaagggacaaggtgacaggacctggtcacagaagagagagaccgtggtgaatgaacctacccatagaagagaaagaccaggggaaaagcttgaatatatggtcaagagaagacaaaaaagtgactgccctatgacacaggaagctttataaattagatccctagatgtgatagagcagacaatgccagggtcttgcggacagagtgagaatcacagaggatatgaagtggaccaggctgtgtcaggagggaactgggtgagccctagcaaagctctgcctctccatctagagtagtggtcctcaatcttcctaatgctgggactctttaatacaggtcctcatgttgtggtgacctccaaccaaacaatcatttttgttgctatttcataactgtaattttgctagtgttatgaattgtaatataaatgtctgtgttttcaggtggtcttagatgacccctgtgaaaatgtcctttgaccctcagaggggtcccagtccatgggttgagatccactgatctagaggattgaaaagtttggtcagaccattgtaactgactgtatagttgctatcttcagtcatccaggaggccttggctcaggccagcctacttggtgagttccaagccagtgagagatcccatctcaaaaaacacagggtgggtgatacctgaagagtaacatctgaggttgacttcaggcctccttgtgcatgcacaaacatgtacacaaacacatacatgtgtacccccccacacacacacacacacaagcatgcttacatacacatatatgcaaacataccaaagaaaataagtataagagataaatttcttaaaccaatcctggcccactcatgacacaaacttaggtgaacaattatcaacccaagtgtttttacataccagatgtctacatgttgaccatgtgccagctgatgaaggggcagcttgcagtggggcactgcaagacttctacttagcttggattttctacttcctgtggctttctgttgctgacattaccctagatctcaccagcagcctagaaggaagacatcagggaaaaaattgagttcagcaaaagttgaaaatactacttctgaggtggtgatggtgaaccaagaagaaaatcccagaaatcttatgtgtgtggaccagctcagatgccaggcccaagtttctctcacagcagcatggcgcagcaagggcttgcttctgctgcccttgtgagtaatggaaggcatgctctctgcctctgaaatgtcctgaagccactaatgctctaggtgcaggattcacagggtgttttgtgagttaaatgatggaggtttcagctgctgagattgggctcatttgttacacagcagtaggtaatgaatacagaatacatcgtcccactcggttctgcctctgttcttctgcaaacagactcgtcttgacattgcccaagtctgtcttgagggcacctagctctgcccagacaccgagaaacaccctcacccacacattctactacttcctctttaaagggggtattttctgccttgtctcaacaagtgaggagaaggcttcactttctctatgatccgaccatgcaaattatcatttaaatttgaaatgtcccccccactagcttgtgcatttaaagacttggttcctaactgctaacaatgtcttgggagaatgtttaggagtaagtggatggctgggcgtggcctgatttctactagagcaccctctgcttcttcatcatgagatgaatcagctgccttacatcctgccaccatagacgaaagccaggccaccactgtgcctctccatcatgatggagactctactatataccctggaacagaagccaaagcgaattcctccttcttaagttacttccatcaaggaaaaaataatgaatgcaacagttttatcaaaacctggatcaaatggagagggatgacttaggggtacctaccacctgcaagaagcgctgacttaggtcctcttggacactctgcttcactccaccctggaccagtcagagttgtgcctcctgcctttctggtgttgtttcagggctcccagttcacagaggctggagctgagacacagagtaatagaacagcttgccgggagtcagctggcttgggcaggctttaaaaaacaacagcccattatctgatttgttcccatataaaggtgttagatagaccctaagagacagcatttgctttgcccctggggttgatgttccttggtctcatagatcactgcctgcactttattgaagggtgtgtgtgtgtgtgtgtgtgtgtgtgtgtgtgtgtgtgtttgtgtagctaggaggggagaatagaaaagattcctcattgacagcataacgtaagtaagtgcatgtgtgcatgatcacacaaggtaagaataagggctgtgcaaaaaaaaatccttaatatgcagagggtattttgtagaaagtgatcactggagagggaagtgatagggtcacgtccacagggacggagagtggtgaggaagcagccctgtaccctggccttctgtgtccatgttgaagaattctggctccttgtctctgaggccaaagactgtgatttatattttccttctcagtccttggctctctctgcattgcagacaagatggtttcttgggctgcagagatggctcagcagttcaaagcatgcattgatcttgtagaggacctgggttcagttccatgtcttagctgttacaaacagtgttctaataaacatggacacaagtgtctatgtcatagtatatttcactccctgcggatacttatctagaagtggaatggttagatcatgtagtagatctacttgtatcttttttagactgttcttcactgttcttcacaatgcctatatcaatctaccttcctgtaaacaataggccagggtccctactaatttacatcctcaccacaagttttttttctagttaacaatctaataattttaactaataaaatttaaatctcttatgattcttagtatgcatgtggacatgtgtgtatgcatgtatgtgtcacagtttgtggtgttaggttcccagcttgcacagacagcacctgtgccctctgagctgtctcacgcccaccctctgggcctcactatgactagggcaaagtagcacaccgtgtaattctggtatgactttctctgctggctgatgaagctaagcatgtgccctctatttgttggccatttagagtgtgtacattgcccagtgacctaactttctgcccctaggaacaaccttctagaaatggttctgtcaacccctaaaagtcaacaagccagcaaccaattcatgattatttatacatggccttcagcaaatacttaagatctaaaccattacaacaccattggggaaatcatttgttatctggcattccttaaccttaaaacatagaaaaaaagccatacatatatatgcatatatgtgtttgtgtgtgtgtatatatgtgtgtgtgtgtgttttctggtttttcttaaccttaaaacataaaaaatacatatatgtatatatgtgtatatatgtatgtatatgtatatatacatatgtgtgtatatatgtatatatgtatgtacatatatttgtatatatacacatatgaatatgtgtatatgtttatatgtatatatgtgctttatatgtttatatttgtatttatatgtacatatatatgtacacatacatatatacatgcacacatacatatacacacatacatacatacatacatacatatgtgaaataaggaatactgggactagagaggtagcatatttagtcaagtgcttgccacataaatataaggacatgagttcaatccctagaacatgcattaagggaaagaaagaagaaagaaagaaagaaagaaagaaagaaagaaagaaagaaagaaagaaagaaagaaagaaagagagggagagagagagagaaaggaaggaagaagggagggggatagagggagggagaaagtaagaaaaggttgggtgcttgtgatctcagtgctggggtgcaggggcttgttggctggctaaccccatctattcagaaagctccatgccaatgagagagcctgtctccaaaaccaaggtgcatgatgtctgaagaatgacctctggccaccagatacctgtccacgtgtacatgagcaccaaacagacacacacacacacacacacacacacacacacacacacacacacaggaagaaaataccaagacctcagaaaaactgcctgccatctttgtacctgtctagtctcattcagggattaaatgagatgcttggcttacatcaggcaggattatgcttttctatacagaaaatctccatcaatgatagcagagcactctactgctgtgtgtgagcccagaggttccacacctaaacacacacacacacacacacacacacacacacacacacacacacacaggagaatggcagtggtcagctgcggcttgccgcttttccctcagtgtagaaggcttcttgaacagtttgcaaccttcattgtttacagtggtcttccaggtatagtaccaaatactaggaccttgttcccctagcaaggacacctctaatttcattggaatagccagcctctccgggttgtgccaacccgactcatgccctttcctgcacactctttactagggatgcttggagggtggtggctgtaaaggtcaagtaaggcttttgctcatcttctctagatgaatcaaatggtgggttaagatgacaaaggaatggtgggaaactggagggtctcatacacggcgcaaaggctgatgggggatgctgtccatcataacagcagctaacaagggatgttcattatgaccctatgctagtcctcacattcaagttcgccagcatcacctggggcttctctttgtattaggttcccagagacggaggctcattccagcactgtctctcgataccccctcacctgtgaggaaaactgccagcagcacaggggtccgctgggtggacggccccttgaggagcacccagaggagccttggggaaccattcgaaattaaagtctatgagattgatgacgtggagcgcctgcagcgacgtcgaggagctacaagcaaggtgaggccacttcctcctcaagggtcatagatcccccaggttccgccctaaggatagaacttccagagggccttcacaggtttctgggatggccagtggatggcgggcggcagggctctggtcccagccacagactttggtagatcctgtgtgttcatttcctggaacaccttaaaagctagtgagcctgagttctgagggacttttctggctccttgttctgaggttccacacatgagtgcagactgatattttggggagccatggttcttctagattagtacagcctacagtagtctccctggagttgggcgtcttgtctgttgaggtcatcaggatcctatcatgcctctggaaacctgggctcctgtcacccgcccctcccacagtccttctctctggaggtggctgcagggatgagtcagagtggaaggccctctgcttttcttctctctactgcccacctcttcctctgtgaacaggaggtcatgtgcttcaatgccaagctgaaaatcctagaacatcggcagcagagaatcgctgaagtccgagccaagtacgagtggctgatgaaggagctagaagcgaccaagcagtacctgatgctggaccccaacaagtggcttcgtgaatgtaagacccattggcacatgcccatctttgctatcacagtggtctccagtaacacaatctaggagcctaacccaggatgacagccacagagactgcttgcatccgaggcatggggctggtgggatagagatgtcctaaagagtagcaatccttctatctatcaggccagggcaacagagggctagtaagaattcctgtataagatactttcacttgagggtcttagttgagagcacctgaaagcaaaacgtattatcttccctacacctggcagaagattctaagccatagactcatgaggtttatctagcctaaaatggaccaggactatagctctcttcatagactaatatgtgccacccacaaactgttcctggtgaccctgaaaatccaatgaccagctcttgggttaattccattaagccaagagcccaggtgatagtaaccaccaggtaactatttgtaatggtgctgttctttttgagagatagatttgattgtccctaatttatttgttaccagctattccatttacttcaaaataaggcttaactttgctccggctattaacactgatatgggaccaatcctggaaggctttgtctgtctgtaggtaaaatacaacagcagctttacaaaggctctctccacaactttcctgcccagctcttccctccaacctcctcttgttaacaccttctcctgcgagtcacaccctcctggtgctccctgctggtgaggaatctcacagatggagcctagaggcttggatgtgtgttccaaagagctgggtttagaacagactggaaacgatgatacaggtgaagaaaggctcctgactagcttaccaagagtaataaacccaccttcacagcgtctctttcttggaagctgagaaaatagagagccctactatttggggctgcatctatgtccctgctcaaggtcccacagacatgatttcaatactggcttttgctacgtgctggctgtgtaactttgggtaaggtgttttctgactttgggtcttggtttccttgctataaaagagaagagtggtcatgcccatcccatagggtggttctaggctgcagcaaatgtttatgctgcatggtccagaggaggagtttggcatcttggaatatatgcagttatcccagagttcagtcaactagatagtctggcagcagctacttcttcagtgcctgtttgcatggtacaaggttagttccttggttagagatttgagcagagatacaaactcccccaccaacaggattttcatctcaagtagaatgagaccaacatgggaatgaggatgagcccaaatctgactgacacctaagccgcccaatgcctcttctctgctctctcctttgtctttcatggacacctgggtccatcctggccccttaggtggcaccctcattttcgccatccttgtatttttcaaaagcagcttatgcccaagacaggcttgaaaatgaccatcattttccaaactaaatttcttcccccccaaccctgggatgcgaatgagcttacacacccgtgcacatgtgcctcagatgcttggagtgtgcaattgctctcttcctgccttggtacatgtcaagggttggtagtatttctttttttgatgctgagacaaaaaacagaaggtcacatgaaagggagaaatacagatatttttaaaaagataaatttaaactaggaatcagaagaaaaaaaatcaaggagactgagtgctaactctcaagacggatgggtagtggacaatgctacaacaatgcgatgggctgagctccatctccagttctagcttcccctccttttgcctctctacagaggagcctgtgagggtgtctggtgtgcttgggatagggtgaggctctggtttcaatttactgagctgagatgtagagggaccctgggtctgtctctagccacagtgcttattagcaatataaccttgagcgaggactacatgcatagctgcccctgttaaaagaactctactccatgacagaccctcgtgtttctgtatcgggtgtggttttgcacatctgtcacatttatgttatgttcttcttgttggtgactcaagatggataggagaagaaggggaagggacccctccacttcctcctcttgtgttgctgttaaggaagcgatgcaggctgaggtagttttgcccggctgggaatttaatgtgaggtccctgctaagctacccacccccatcaactactgtccattccctgctgctctccccattcagaccttttataacacccctcaaaatgagatcaggctctgccaagccattatgggggcaaaggaactccagatccctgcccctcaggaaaggaacgcacaaggacttttgttgctataggcctgcacccgatgcaagacacaatggccatatgactcgatttgtgttttgagcctaaaggttgtcttaattgttagtacatgttttttaaacatcatatgtacacacacacacacacacacacacacacacacacacagtgaccagtgaggtgagcctggtgaagctgggtcaggtcatggttttgctgagcacctcagctctcaggcagaggagacaggaagactgggaggttaaggctcacttcaggtgtattgagagttagaggccagcttgtgttacacaaggcaagatcaagacccccagcctgaggggtagcaacacatcacacagggatgggaaacaggaacctcctttttctaggagggtggggtatgcatgtcactcatcactcctgaaagggactcttgctgccttagcatcccaagagtttcttgcctcaaagatccgtgttggaggcagcgagggtaggcatcggaagttctagaccacctccctgttccttagaattgtctctgaatgttaagaagctagaaaccagaatgggtgtcacttcctctggctgagggccaggcaggaggggatgcttatgtggcacaactcagttgcccttagcccagaggaggtgggggaggcagaccttcttacagttagctctcccatctctaagagctcctttctctttcagttgacttggagcaggtcctgcagctggattccctggagtacctggaggcactggagggtgtgacagagcgcttggagagccgcgtcaacttctgcaaggcccatctcatgatgatcacctgctttgacatcacctccaggcgccgataaggactgatgggctctgagccatcaggccctctctcccccaggacttcagcaggacaccgccctcccaagccctctgtgctggcaacacccaagacaacaggatgaggatgaaggttggtagcaagtctggagtgagcgtggagcgaaaggcgatgtttcctttgtttgccataggaaagaaaggtacagacaccaacatgtggaaggaggaaatgatgggaagccccgtgggactgagaaagcactttgaggaaccttgaagaactctgtacataggaccgctagcaaagagactcttaccttgcggctgtgggaaaggggagggtgacatgggattaccatggagaacgaaacaccaacaagatgacccagaatgatggattaagtgccttgcaaatctttatgattatccaaacattgtgtccgtactttcttgtgtccagatggtgctagtcaagaagaaatcaacaaaacagaaaactcaacccagtttttgaaatgtattgacggcttgttttctcttggtatttttctcttgtttctgatttgctgtttgtttctaagaagttgtgtttgtagtgatgtctcctaatcggtattgcagctgaataaatgttaactgtctttcatggctcttctggtaaggccactcagaccgtggaaaccgcgttggcatgagccggtgtgtttcccagggaggtttggaaggacaggtgatgggagagactatcttccaaagcggcaggtcagctggcagacccagggttgggcatggaataggtacacatgagctttagtgacaaggagagatgtctttaaggggaagagagatgtgagcccctgtccctgtttgtttcatgggcttgtggctctcaacacaagctcatgttcctttctagcccaaagactggctggaaagcttgggcaaccgcagccgagtcccatttctttgtttactgtggcatcactgatgcaaagtggggctgtctacatttcgactctctgggctcacacgggcttggggttgcatcgttttctgccatccagtgtcctgtccagtagcaagaggccaactctcccctgtcctaaagcctccatggcttgtccctgccaccttagtatcctaagaaagagagagaaaccccatccctaaattccagaccccacatacatagggcagagtggagatctagatcttgcccccccccccaaaaacctgaggactttattctcaaattatcctcctcctttcagggctattggaccatgttagggagataggactgaagcatggaatggtcaggcattgtctacaggcctctggaacaactgagcattgcaggagggccaagaattctctctcccagagcctctgcagcctgcctgtgcaaacacaagctcaggggtttggaaagaggactctgaatcctcaacctttgtgtggcacatctgggccagccccactaaccaactccttgaccccagatgctctctaaagagaaagaactctgtgtttctggaccagcccttttgctggacgcctgcatcccagcacagcacgatgcatggccagcagaactcatcacacaggagtcatgtgagtgctgtggcacctgatccttgatacagagcagggcacagatgaggccatcggcttgactgttttagaagtcagccttgtagaccaaaagctagccccatgggtcactcagtcctgctttgcacattcctaagagttgactcttctgcaaaagggtcccaaggtgctgattgaatggcctgagctctggaatggcccctttccccttctgtgtatcttgtagctttaacaagtgtgtctcctagagaagcagagccttctcagatcttctccagctcctcccagtgccattcggcaggagtcctgggctcagggcccacctcagcctcataacacatgtgtgcatggacctgcttaacagcaatgttcttggaagcttctacacccataggggtgccaatactttgaacatctgttttgattgctggtttgaaatatacttctgttttgtttcttatgaagggccttgatttgggaagttttgctcaaaagcaaattcatttgattagtaatccatgagcttggctttggtccctgctgccttttcccttagccgtgaggtcatcaggccccagtgaatactttaacgggccaccaacaaagcccagtgcctttgctggagtgagactgggctgacatctgtagaaagcagactcttagtcagcaggttctcctgggagagcagccctcggttgcctcccactcggatttgcttgcataccttccaagcatctttatgcttcagctaggccatattaccagggttacttgaccaggcgaggttagcttcccagggggtcacatccacatgacagggcatcccactggactccaccggtggtgcagggagatgtttgtgtgaaataatgcacatctcttgtccattctaatatcctgcccccccccacacacaagtaagctgtaagcatcttattctaccacatagctctatcttagctgataagccttggagaactccggcatcccatgatgcaactgttccctgccctatctctgagatgcctatgggagtacaactctctaggtgccaagacgtagtcctggtgtctgatgatggtgccagtgtgaggtggctccgggtttggcttgaggaacacgcaaacaaataccaaggggcaaagggaccgccaaagaactcacttataattcattatccatccgtagatggccccaaagtgtttccttgaaattaatatttaggttcctatgccttacttgaattctgtccttccccccataactgcagctgttgatagattttacaatcctaataaatctgtatagaagacacacaatccagatattttcattataagccacatgcctaggttgggcagatctagggctatgctaacttattctccggctataagaccccttgatacttgctgtctctcctggccacctgattctggtccatggccactgcctgctccaccatcttcttcctctccccatctctgtccagatcttcaactctctcttgagcctccatccccatcttccccttccactgcccaatcacaggctctagccttttattgaccagttaaactggggagacagttcgcatggcatcagttgagtttgtgatggtctgggcaaccacttctgtaggaatcagtgttagcattaggattcaaaccacatcatctagccctgcttcaaagaatctagtgtgaggcagaagcattttcagcccaagtaaaactaaaatctgaaacaggggcatcattctcccaggaggaaacccttagttcacctcacctgggccaggggataggtgcggttgctctgagggagctggggtttgctttcagtacccacctaagagctgaatcttttgagctgaatcttttatcttatctctgaacccttctggaaacctccggacgctgtctctaactttcatctcagcagaggtgaaacccagaccactctcttgtggtttcaccttcagttgctgttcccaacatggggaacataagatacagtttcagagatggaccctctgatggcatagcaatgactcaagtaatgacccccaagcaagaaaatggctcctgagctagagactagtgtaaggaacatcacacagctccaggaaatggggcaaagggtgggcagcaggaatgttcatccagtgggaaccaggtcccatttgccacaaatcagcttaaagatggaggtctaacatccaggaaggagctccaatgctctgtagggaagtgctcccaagggacctaacactcaggttgtgcttgctgcagggagttccatccaaactttgagcaagaaaagcatctgccctgtgggcatggatcccacatccttgaggaacagccaccttctctggtcttcggagtctcgtgctcttcgttcatgaggatccattcatatgccttcttcacagctctgtatttcaatcccgctgtctgcccttgactttccggtaaagaaggtgaggttggcaggagcccacaatttgctcagtgcaaacatggcctttgccgatctgtagctgagcccgaagtgaatgttttttgggtttccttattccaccaagaattgtagtctgtaaaagaaattactaaaaatgagttccttccaaaatcgaaaacagatttcctgaatgttgttctttccttgggacatatgcaaaaacatttcctcccttttagggtagtttatctttaaaaccaaagccagggcccattagaaacatgttgaaaatcctgtgttctatgagttgatgctgactaagccatccactgtcatcgtccttcctgccttcctgccactgcctagatttggccctgatttccacattgaaaggggtgtgcttagtgctaacacatgtgtggctctgggagaggccgacacagcccgctgctcttctctgagccaagttaaacagctgagggcaagtttcacagacatgattggttaatggttctaatttttttttcaagtgatagaaacacagcattcttgtacagtatatagattaccactctcctggacaacatcagtaacctctttacaacattacgaagccatttgtaaaaacacataaattgtattgtttagccatcttcctgatgtgtcagaatatatttctaagtgacaaactctgaattatttccataagaataaaagcaggattataaccaaggaaactatcttaaatccaatgtatcctctcaaaaataaggggggaggggtggtgaaaacatctaagagttaatttatccattcctaaacaaacacattctactttggggtggccctttgcaaaacctgaggtgatgtcacaatgttggacatagtgtgacactgtgggaggggcgaagctgaatattctccacacacaacaattactggtgtcatgtgaaagtgagcactccaatccctgggttttatgtccacttagaatgaccttgcccaaaggagtctcctgcatccattccccacaccgccagcctcctacactgccaggcttgacttaaggagacattattgatttgtaacctcagaatgctgtcctgtaacaccgcttatgttcctagatctatttctgcactgtggtcaggaacgccctccacacgtcctgagttgaagtgtgtgtgcttgctcggtctgtgttttgtcttttttcttctgtttttcttactccagcgatgtctattagcagagacatgggccagggaagggtgatggatacagccaggggtgggatatcagcctcaaagtgcagagctttgctctgaatctcagcaggcagccaaagggactgagacaaagctcttcctttcaagttggcatggcaatcaacttggaaatcaggttccccgggcctttgccttcctaacaaaggatccagcctcctccaactgggtctccactcagcccctgtagaaaagtgctgacagtattaagttctactcttccctaagaccccaggaggtcctcaccgtgcatagatgtgccatctgttcttgagaaaccaaagcactttagtgagtcttacaacccataatacttacagtatttgccctctgaaaggtggaaggggcttgggctaggtctcatttgagaggcaactagagctaggaggaaaagcctggagctagacagcagggagctaagccacatctgcaccaccacaagctatgaacctcgggtaggttgctgaattttgctgccccccccccctagacagttgtggggaggtcctaacagctaccctcctgggatggcagaaaaggaagggaataatataactggtgggacacgctttgaagaaatcagaagctctctccagaggggagggaggatcatgtatagatgaagaagttgacatccgtactcactgcctggccaggttcacagtctcacagcagaactgggacatgagccccgccacctggagtgtccctgatagagcacctttcacccagagtgtgtacatgaacacaggctgcttctctgtgccagtgtgtgcacatatgtgggtgtgtctgtatggggggtgtgtgcagcacagatgaacgtaggacagaaactccgagtcctaattcctttctaacagtcgacctgtctgtggcctgggacacacaaccaactcttctggacctcagattttctaagtcataaaacaaggacattgtggcatgggatctttgtggttcttccaactttggtgacgagagcccctaacgggtgatgtatgtatgtatatatcgatatgcttatctgtagaaacgggcccattgggaaattggagacgaggcctgcccgagtgcattgacttgtaacagaatcggcaacttcacaagtccgtaagccttcattttaaaagtcgatgggatggtgtcatttactgtcattgtttcaaattcactgttgaactgggtagaggattggtgctgttttaaaaactaagttcttagctcacaagtgtttgctgttacttttcaaaacacgagtcatttgttcaaaagtcaaacttttaactctgccttgggcaggtccccaacagcctgttttgcaggctgggttttgtgtatgggcttttacataactatataaaagttagctgttggcttgatcatggtaaatatgaacagattgcctggagaacagtccagaaaagaattgaattctatagttctcatcaactggtgacatgaaaccattaagctgtgtgcaattccctggtgtgaagatattgttcactggctacagtctctgactttgtggcatatgaggtataaaatgttgtaaaaaaaaaaaatctggtgtttaaaagaatcaaagtatggtggcattaaatgttcacttttatccta

SEQ ID NO: 5 - DNA, 20 bp, synthetic construct
  source 1..20: mol_type = other DNA
cgtgttcttcacactgcaca

SEQ ID NO: 6 - DNA, 20 bp, synthetic construct
  source 1..20: mol_type = other DNA
gacatcgcctaccagctcat

SEQ ID NO: 7 - DNA, 20 bp, synthetic construct
  source 1..20: mol_type = other DNA
acagtagatggacctcggga

SEQ ID NO: 8 - DNA, 20 bp, synthetic construct
  source 1..20: mol_type = other DNA
gtagtgaagagacccaggcg

SEQ ID NO: 9 - DNA, 20 bp, synthetic construct
  source 1..20: mol_type = other DNA
aacctgcagagcatggactc

SEQ ID NO: 10 - DNA, 20 bp, synthetic construct
  source 1..20: mol_type = other DNA
ccttgcccgacttgaaggta

SEQ ID NO: 11 - DNA, 20 bp, synthetic construct
  source 1..20: mol_type = other DNA
ctgacggcaacttcaactgg

SEQ ID NO: 12 - DNA, 20 bp, synthetic construct
  source 1..20: mol_type = other DNA
gggaggattgtggccttctt

SEQ ID NO: 13 - DNA, 20 bp, synthetic construct
  source 1..20: mol_type = other DNA
ctttggctacgagctgagca

SEQ ID NO: 14 - DNA, 20 bp, synthetic construct
  source 1..20: mol_type = other DNA
tgatgcgctgacggatgatt

SEQ ID NO: 15 - DNA, 20 bp, synthetic construct
  source 1..20: mol_type = other DNA
cgagcccgatctgaagaagg

SEQ ID NO: 16 - DNA, 20 bp, synthetic construct
  source 1..20: mol_type = other DNA
cccagaggtgacaaaggaga

SEQ ID NO: 17 - DNA, 20 bp, synthetic construct
  source 1..20: mol_type = other DNA
ggcactagtcaaccctttgg

SEQ ID NO: 18 - DNA, 19 bp, synthetic construct
  source 1..19: mol_type = other DNA
ctgcactgccaagactgag

SEQ ID NO: 19 - DNA, 20 bp, synthetic construct
  source 1..20: mol_type = other DNA
ctcaactcggtggccattca

SEQ ID NO: 20 - DNA, 20 bp, synthetic construct
  source 1..20: mol_type = other DNA
ccacctctgacttctgcctc

SEQ ID NO: 21 - DNA, 20 bp, synthetic construct
  source 1..20: mol_type = other DNA
gtccaagcaggagggcaata

SEQ ID NO: 22 - DNA, 20 bp, synthetic construct
  source 1..20: mol_type = other DNA
ctgactgacccttcgctctc

SEQ ID NO: 23 - DNA, 20 bp, synthetic construct
  source 1..20: mol_type = other DNA
gaccgacgattccatgtcca

SEQ ID NO: 24 - DNA, 21 bp, synthetic construct
  source 1..21: mol_type = other DNA
aggtcggtgtgaacggatttg

SEQ ID NO: 25 - DNA, 20 bp, synthetic construct
  source 1..20: mol_type = other DNA
tttcacacagctgccgagat

SEQ ID NO: 26 - DNA, 20 bp, synthetic construct
  source 1..20: mol_type = other DNA
cctggctttctcgtcactct

SEQ ID NO: 27 - DNA, 20 bp, synthetic construct
  source 1..20: mol_type = other DNA
ggatgaggaatgcgccctaa

SEQ ID NO: 28 - DNA, 20 bp, synthetic construct
  source 1..20: mol_type = other DNA
tcagccaactcgtcacagtc

SEQ ID NO: 29 - DNA, 20 bp, synthetic construct
  source 1..20: mol_type = other DNA
atactggtgaggttcacgcc

SEQ ID NO: 30 - DNA, 20 bp, synthetic construct
  source 1..20: mol_type = other DNA
tcctgttccttctgggccat

SEQ ID NO: 31 - DNA, 20 bp, synthetic construct
  source 1..20: mol_type = other DNA
gtccaatgtccagcccatga

SEQ ID NO: 32 - DNA, 20 bp, synthetic construct
  source 1..20: mol_type = other DNA
atccacagggcgatgttgtc

SEQ ID NO: 33 - DNA, 20 bp, synthetic construct
  source 1..20: mol_type = other DNA
tctgtcatgttgcctgcact

SEQ ID NO: 34 - DNA, 20 bp, synthetic construct
  source 1..20: mol_type = other DNA
attggccttcacactgcgat

SEQ ID NO: 35 - DNA, 20 bp, synthetic construct
  source 1..20: mol_type = other DNA
ccagtcgtagcctttgagca

SEQ ID NO: 36 - DNA, 20 bp, synthetic construct
  source 1..20: mol_type = other DNA
caccttggtctccagaagga

SEQ ID NO: 37 - DNA, 20 bp, synthetic construct
  source 1..20: mol_type = other DNA
ctgaaccctggtaaccctga

SEQ ID NO: 38 - DNA, 20 bp, synthetic construct
  source 1..20: mol_type = other DNA
tggtcttgccattcctggac

SEQ ID NO: 39 - DNA, 20 bp, synthetic construct
  source 1..20: mol_type = other DNA
ggtctctgtcatcagctggg

SEQ ID NO: 40 - DNA, 20 bp, synthetic construct
  source 1..20: mol_type = other DNA
gaactgcctggggtctgaaa

SEQ ID NO: 41 - DNA, 20 bp, synthetic construct
  source 1..20: mol_type = other DNA
ttaagctcacactgctcccg

SEQ ID NO: 42 - DNA, 20 bp, synthetic construct
  source 1..20: mol_type = other DNA
ggtcaatcctgcctccttcc

SEQ ID NO: 43 - DNA, 20 bp, synthetic construct
  source 1..20: mol_type = other DNA
attggccttcacactgcgat

SEQ ID NO: 44 - DNA, 23 bp, synthetic construct
  source 1..23: mol_type = other DNA
tgtagaccatgtagttgaggtca

SEQ ID NO: 45 - DNA, 57 bp, synthetic construct
  source 1..57: mol_type = other DNA
ccggcttggctcttcaagctcataactcgagttatgagcttgaagagccaagttttt

SEQ ID NO: 46 - DNA, 57 bp, synthetic construct
  source 1..57: mol_type = other DNA
ggccgaaccgagaagttcgagtattgagctcaatactcgaacttctcggttcaaaaa

SEQ ID NO: 47 - DNA, 52 bp, synthetic construct
  misc_feature 1..48: note = DNA
  misc_feature 49..52: note = RNA
  source 1..52: mol_type = other DNA
cttggctcttcaagctcataactcgagttatgagcttgaagagccaagtttt

SEQ ID NO: 48 - DNA, 57 bp, synthetic construct
  source 1..57: mol_type = other DNA
ccggctgacaacctgctcatcttatctcgagataagatgagcaggttgtcagttttt

SEQ ID NO: 49 - DNA, 57 bp, synthetic construct
  source 1..57: mol_type = other DNA
ggccgactgttggacgagtagaatagagctctattctactcgtccaacagtcaaaaa

SEQ ID NO: 50 - DNA, 52 bp, synthetic construct
  misc_feature 1..48: note = DNA
  misc_feature 49..52: note = RNA
  source 1..52: mol_type = other DNA
ctgacaacctgctcatcttatctcgagataagatgagcaggttgtcagtttt

What is claimed is:

1. A composition comprising a small hairpin RNA (shRNA) against KIF26B, the shRNA comprising: SEQ ID NO: 1 or a sequence at least about 80% identical to SEQ ID NO: 1; SEQ ID NO: 2 or a sequence at least about 80% identical to SEQ ID NO: 2.

2. The composition of claim 1, wherein the shRNA is encoded into a lentivirus.

* * * * *